US008153369B2

(12) United States Patent
Cotterchio et al.

(10) Patent No.: US 8,153,369 B2
(45) Date of Patent: Apr. 10, 2012

(54) ASSESSMENT OF RISK FOR COLORECTAL CANCER

(75) Inventors: Michelle Cotterchio, Toronto (CA); Steven Gallinger, Toronto (CA); Celia Greenwood, Toronto (CA); Thomas J. Hudson, Toronto (CA); Brent W. Zanke, Ottawa (CA); Michael Phillips, Hudson (CA); Saravanan Sundararajan, Montreal (CA); Alexandre Montpetit, Montreal (CA); Phillippe Laflamme, Montreal (CA); Vincent Ferretti, Mont-Royal (CA)

(73) Assignees: Cancer Care Ontario, Toronto, Ontario (CA); McGill University, Montreal, Quebec (CA)

( * ) Notice: Subject to any disclaimer, the term of this patent is extended or adjusted under 35 U.S.C. 154(b) by 112 days.

(21) Appl. No.: 12/303,410

(22) PCT Filed: Jun. 5, 2007

(86) PCT No.: PCT/CA2007/000993
§ 371 (c)(1),
(2), (4) Date: Sep. 23, 2009

(87) PCT Pub. No.: WO2007/140599
PCT Pub. Date: Dec. 13, 2007

(65) Prior Publication Data
US 2010/0047782 A1 Feb. 25, 2010

(30) Foreign Application Priority Data

Jun. 5, 2006 (CA) .................... 2547824
Jun. 13, 2006 (CA) .................... 2548375
Feb. 21, 2007 (CA) .................... 2579588

(51) Int. Cl.
*C12P 19/34* (2006.01)
*C12Q 1/68* (2006.01)

(52) U.S. Cl. ...... 435/6.1; 435/6.12; 435/6.14; 435/91.1; 436/64

(58) Field of Classification Search ............ None
See application file for complete search history.

(56) References Cited

U.S. PATENT DOCUMENTS
2005/0047996 A1 3/2005 Vogelstein et al.

FOREIGN PATENT DOCUMENTS
| WO | 02/12567 A1 | 2/2002 |
| WO | 03/070082 A2 | 8/2003 |
| WO | 2005/079173 A2 | 9/2005 |
| WO | 2005/123961 A2 | 12/2005 |
| WO | 2006/104370 A1 | 10/2006 |

OTHER PUBLICATIONS

Kupfer (Carcinogenesis, 2009, vol. 30, pp. 1353-1357).*
Curtin (Cancer Epidemiol Biomarkers Prev 2009, 18(2), pp. 616-621).*
Gruber (Cancer Biology and Therapy, 2007, vol. 6, pp. 1143-1147).*
Schafmayer (Int J Cancer, 2009, vol. 124, pp. 75-80).*
Ioannidis (Nature Genetics, vol. 29, pp. 306-309, Nov. 2001).*
Hirschhorn et al. (Genetics in Medicine. vol. 4, No. 2, pp. 45-61, Mar. 2002).*
Pennisi, Science, 1998; 281 (5384):1787-1789.*
Alignment of SEQ ID No. 1084 and rs10505477, printed May 31, 2011, pp. 1-2.*
ReferenceSNP cluster report:rs10505477, available at www.ncbi.nlm.nih.gov, pp. 1-4, printed May 31, 2011.*
Buffart et al., Cellular Oncology, 27(1):57-65 (2005). "DNA copy number changes at 8q11-24 in metastasized colorectal cancer."
Poynter et al., Cancer Research, 67(23):11128-11132 (2007). "Variants on 9p24 and 8q24 are associated with risk of colorectal cancer: results from the Colon Cancer Family Registry."
Zanke et al., Nature Genetics, 39(8):989-994 (2007). "Genome-wide association scan identifies a colorectal cancer susceptibility locus on chromosome 8q24."
Abecasis et al., Am. J. Hum. Genet, 68:191-197 (2001). "Extent and Distribution of Linkage Disequilibrium in Three Genomic Regions."
Carstensen et al., Int. J. Cancer, 68:428-435 (1996). "Familial Aggregation of Colorectal Cancer in the General Population."
Clark et al., Am. J. Hum. Genet., 63:595-612 (1998). "Haplotype Structure and Population Genetic Inferences from Nucleotide-Sequence Variation in Human Lipoprotein Lipase."
Collins et al., Genome Res., 8:1229-1231 (1998). "A DNA Polymorphism Discovery Resource for Research on Human Genetic Variation."
Crow, J.F., Exp Clin Immunogenet, 12:121-128 (1995). "Spontaneous Mutation as a Risk Factor."
Daly et al., Nature Genetics, 29:229-232 (2001). "High-resolution haplotype structure in the human genome."
Dawson et al., Nature, 418:544-548 (2002). "A first-generation linkage disequilibrium map of human chromosome 22."
Dunning et al., Am. J. Hum. Genet., 67:1544-1554 (2000). "The Extent of Linkage Disequilibrium in Four Populations with Distinct Demographic Histories."
Gabriel et al., Science, 296 (5576):2225-2229 (2002). "The Structure of Haplotype Blocks in the Human Genome."
Herzog, T.J., Gynecologic Oncology, 90:S22-S27 (2003). "New approaches for the management of cervical cancer."
Kikuchi et al., Oncogene, 22:2192-2205 (2003). "Expression profiles of non-small cell lung cancers on cDNA microarrays: Identification of genes for prediction of lymph-node metastasis and sensitivity to anti-cancer drugs."
Kondrashov, A.S., J. Theor. Biol., 175:583-594 (1995). "Contamination of the Genome by Very Slightly Deleterious Mutations: Why Have We Not Died 100 Times Over?"
Liu et al., Genetic Epidemiology, 27:385-400 (2004). "Haplotype Block Structures Show Significant Variation Among Populations."
Guttmacher et al., N Engl J Med, 348(10):919-32 (2003). "Hereditary Colorectal Cancer."

(Continued)

*Primary Examiner* — Sarae Bausch
(74) *Attorney, Agent, or Firm* — Nixon Peabody LLP; David S. Resnick; Leena H. Karttunen Contarino

(57) ABSTRACT

Disclosed is a method for identifying an individual who has an altered risk for developing colorectal cancer comprising detecting a single nucleotide polymorphism (SNP).

5 Claims, No Drawings

OTHER PUBLICATIONS

Ponz De Leon et al., Gut, 45:32-38 (1999). "Hereditary colorectal cancer in the general population: from cancer registration to molecular diagnosis."

Reich et al., Nature, 411:199-204 (2001). "Linkage disequilibrium in the human genome."

Rioux et al., Nature Genetics, 29:223-228 (2001). "Genetic variation in the 5q31 cytokine gene cluster confers susceptibility to Crohn disease."

Sachidanandam et al., Nature, 409:928-933 (2001). "A map of human genome sequence variation containing 1.42 million single nucleotide polymorphisms."

Taillon-Miller et al., Genome Research, 499-505 (1999). "Efficient Approach to Unique Single-Nucleotide Polymorphism Discovery."

Wang et al., Science, 280(5366):1077-1082 (1998). "Large-Scale Identification, Mapping, and Genotyping of Single-Nucleotide Polymorphisms in the Human Genome."

Sansbury, L.B. et al., Cancer Causes and Control, 17(3):257-266 (2006). "COX-2 polymorphism, use of nonsteroidal anti-inflammatory drugs, and risk of colon cancer in African Americans (United States)."

* cited by examiner

ASSESSMENT OF RISK FOR COLORECTAL CANCER

CROSS-REFERENCE TO RELATED APPLICATIONS

This application is a §371 National Stage of International Application No. PCT/CA2007/000993 filed on Jun. 5, 2007, which designates the United States, and which claims the priority of Canadian Application No. 2,547,824 filed on Jun. 5, 2006, and Canadian Application No. 2,548,375 filed on Jun. 13, 2006, and Canadian Application No. 2,579,588 filed on Feb. 21, 2007, the entire contents of which are incorporated herein by reference.

FIELD OF THE INVENTION

This invention relates to prediction of the susceptibility of an individual to colorectal cancer. Basis for the prediction lies in relating an individual's genetic makeup, as through molecular analysis, to the genetic makeup of a population of individuals.

BACKGROUND

During the course of evolution, spontaneous mutations arise in the genomes of organisms. Variations in genomic DNA sequences are created continuously at a rate of about 100 new base changes per individual (Kondrashov, 1995; Crow, 1995). These germ-line changes may produce an evolutionary advantage and be retained in the population, or they may be deleterious and ultimately eliminated. In many cases, equilibrium between multiple germline forms of a sequence is established within a population if reproductive ability of individuals containing either polymorphism is not affected. Over time, significant numbers of mutations have accumulated within the human population that may be observed to varying extents in geographically separated groups based upon the presence of common ancestors.

Colorectal cancer is the third most common cancer and the third most common cause of death from cancer for both men and women. Colorectal cancer is responsible for more deaths that are not due primarily to tobacco use than any other type of cancer and inflicts a huge financial burden. Early detection of some human tumors such as uterine cervical cancer has dramatically reduced mortality from this condition (Herzog, 2003). Early detection of colorectal cancer can reasonably be expected to prevent death from this condition by identifying patients at risk for the disease, or those with the disease in an early stage and allow life saving intervention. A validated genetic test for colorectal cancer predisposition will have clinical utility, allowing prevention of cancer mortality through targeted screening programs. There are good reasons to expect that at least some of the genetic risks of common disease is due to common variants—for example, based on evolutionary arguments, and the fact that most human genetic variation is common. Although approximately 20% of colorectal cancers have a familial component with relatives exhibiting a doubling of risk (Carstensen et al., 1996), less than 5% of colorectal cancer is explained by rare, highly penetrant genetic syndromes such as APC and HNPCC (de Leon et al., 1999). Familial colorectal cancer occurring in patterns inconsistent with classical inherited syndromes suggests that variation in genome sequence plays a major role in determining individual risk to colorectal cancer. These genetic causes appear complex due to a variety of reasons such as genetic heterogeneity, incomplete penetrance, phenocopies and variation in exposures to environmental co-factors etc. There is little insight into the genetic or environmental determinants of almost 90% of cases of human colorectal carcinoma (Lynch and de La, 2003).

Although common human genetic variation is limited compared to other species, it remains impractical to discover and test every one of the estimated 10,000,000 common genotype variants (Sachidanandam et al., 2001) as predictors of disease risk. Genotypic complexity is reduced through linkage disequilibrium that exists across long segments of the human genome with restriction in the diversity of haplotypes observed (Daly et al., 2001; Rioux et al., 2001; Liu et al., 2004). That is, single nucleotide polymorphisms found at specific locations within the human genome are inherited in conjunction with nucleotides that can be polymorphic that are physically located near by. In European genomes, allelic association between pairs of markers typically extends over 10-50k, although there is tremendous variability in the magnitude of association observed at any given distance (Clark et al., 1998; Kikuchi et al., 2003; Dunning et al., 2000; Abecasis et al., 2001). Genome-wide data (Gabriel et al., 2002; Reich et al., 2001; Dawson et al., 2002) supports the generality of this description as well as its application across populations. This confirms that measurement of single nucleotide polymotphisms at sites in tight linkage disequilibrium with adjacent genomic regions can provide information about the presence of diversity not just at sites actually measured, but also about large areas of the adjacent genome.

Numerous types of polymorphisms exist and are created when DNA sequences are either inserted or deleted from the genome. Another source of sequence variation results from the presence of repeated sequences in the genome variously termed short tandem repeats (STR), variable number of tandem repeats (VNTR), short sequence repeats (SSR) or microsatellites. These repeats commonly are comprised of 1 to 5 base pairs. Polymorphism occurs due to variation in the number of repeated sequences found at a particular locus.

The most common form of genomic variability are single nucleotide polymorphisms or SNPs. SNPs account for as much as 90% of human DNA polymorphism (Collins et al., 1998). SNPs are single base pair positions in genomic DNA at which different sequence alternatives (genotypes) exist in a population. By common definition, the least frequent allele occurs at least 1% of the time. These nucleotide substitutions may be a transition, which is the substitution of one purine by another purine or the substitution of one pyrimidine by another, or they may be transversions in which a purine is replaced by a pyrimidine or vice versa.

Typically SNPs are observed in about 1 in 1000 base pairs (Wang et al., 1998; Taillon-Miller et al., 1999). The frequency of SNPs varies with the type and location of the change. Specifically, two-thirds of the substitutions involve the C↔T (G↔A) type, which may occur due to 5-methylcytosine deamination reactions that occur commonly. SNPs occur at a much higher frequency in non-coding regions than they do in coding regions.

Known environmental risk factors for the development of colorectal cancer include obesity, absence of a vegetable-rich diet and a sedentary life style. Estrogen use in post menopausal women is associated with reduced individual risk for the development of colorectal cancer. The mechanism of risk reduction through the chronic administration of estrogen is unknown and a way of quantifying altered risk associated with estrogen use is not obvious. It is known that expression of the estrogen receptor beta on colorectal tumors is reduced compared to undiseased adjacent tissue. It is not known if this observation has any relevance to the reduced incidence of colorectal cancer in women taking postmenopausal estrogen, nor is it useful in predicting individual risk for the development of colorectal cancer. It is not known if single nucleotide polymorphisms within the estrogen receptor beta can modify the risk of developing colorectal cancer conferred by certain polymorphisms in other risk genes.

SUMMARY OF THE INVENTION

It has been discovered that polymorphic variations in a number of loci in human genomic DNA are associated with susceptibility to colorectal cancer. This invention thus includes methods for identifying a subject at risk of colorectal and/or determining risk of colorectal cancer in a subject, which comprise detecting the presence or absence of one or more polymorphic variations associated with colorectal cancer in a nucleic acid sample from the subject. In a specific embodiment, this invention relates to identifying an individual who is at altered risk for developing colorectal cancer based on the presence of specific genotypes defined by 85 single nucleotide polymorphism (SNPs), observed alone or in combination. Through large scale genotyping studies on 2,373 blood samples from patients with colorectal cancer and 2,296 control samples from unaffected individuals we have identified 85 polymorphic markers found in 32 genes which are found more frequently in patients with colorectal cancer than in those without this disease. These markers, or those in close linkage disequilibrium, may change the composition, function or abundance of the elements of cellular constituents resulting in a predisposition to colorectal cancer. Measuring these markers in individuals who do not ostensibly have colorectal cancer will identify those at heightened risk for the subsequent development of colorectal cancer, providing benefit for, but not limited to, individuals, insurers, care givers and employers. Genes containing colorectal cancer-associated polymorphic markers that we have identified and genes found in linkage disequilibrium with these that we have identified are valuable targets for the development of therapeutics that inhibit or augment the activity of the gene products of these genes for therapeutic use in, but not restricted to, colorectal cancer. Information obtained from the detection of SNPs associated with colorectal cancer is of great value in the treatment and prevention of this condition.

Accordingly, one aspect of the present invention provides a method for diagnosing a genetic predisposition to colorectal cancer in a subject, comprising obtaining a sample containing at least one polynucleotide from the subject and analyzing the polynucleotide to detect the genetic polymorphism wherein the presence or absence of the polymorphism is associated with an altered susceptibility to developing colorectal cancer. In one embodiment, one or more of the 85 polymorphisms found distributed among 32 genes that we have identified may be used.

Another aspect of the present invention provides an isolated nucleic acid sequence comprising at least 16 contiguous nucleotides or their complements found in the genomic sequences of the 32 genes adjacent to and including the 85 polymorphic sites the inventors have identified to be associated with colorectal cancer.

Yet another aspect of the invention provides a method for treating colorectal cancer comprising obtaining a sample of biological material containing at least one polynucleotide from the subject, analyzing the polynucleotides to detect the presence of at least one polymorphism associated with colorectal cancer and treating the subject in such a way as to counteract the effect of any such polymorphism detected.

Still another aspect of the invention provides a method for the prophylactic treatment of a subject identified with a genetic predisposition to colorectal cancer identified through the measurement of all or some of the 85 polymorphic SNP markers described in Tables 1 to 85.

Through large scale genotyping studies on 1231 blood samples from patients with colorectal cancer and 1240 control samples from unaffected individuals we have identified polymorphic sites within the estrogen receptor beta gene that act as a further risk predictor for colorectal cancer when considered along with colorectal cancer risk-predicting markers on chromosome 8q24. While polymorphic sites within the estrogen receptor beta gene, which is located at chromosome 14q23, are not predictors of colorectal cancer independent of other markers, they strongly modify the predictive power of markers at chromosome 8q24.

Accordingly, one or more of the polymorphic sites within 8q24 may be used in conjunction with one or more polymorphisms within the estrogen beta receptor locus which is found at chromosome 14q23 to more accurately predict risk of colorectal cancer as described in Table 86.

Further scope of the applicability of the present invention will become apparent from the detailed description provided below. It should be understood however, that the following detailed description and examples, while indicating preferred embodiments of the invention, are given by way of illustration only, since various changes and modification within the spirit and scope of the invention will become apparent to those skilled in the art from the following detailed description.

Tables 1 to 85 report the result of a genotyping analysis of 4,669 samples by measuring 99,632 single nucleotide polymorphisms in peripheral blood DNA from 2,475 subjects (1,234 cases with colorectal cancer and 1,241 age matched individuals undiseased at the time of testing), and validating the identified CRC-associated alleles by using peripheral blood DNA from a second, different, group of 2,194 subjects (1,139 cases with colorectal cancer and 1,055 age matched individuals undiseased at the time of testing).

DETAILED DESCRIPTION OF THE INVENTION

It has been discovered that polymorphic variants in a number of sequences, SEQ ID NOs:1 to 1760 are associated with an altered risk of developing colorectal cancer in subjects. The present invention thus provides SNPs associated with colorectal cancer, nucleic acid molecules containing SNPs, methods and reagents for the detection of the SNPs disclosed herein, uses of these SNPs for the development of detection reagents, and assays or kits that utilize such reagents. The colorectal cancer-associated SNPs disclosed herein are useful for diagnosing, screening for, and evaluating predisposition to colorectal cancer and related pathologies in humans. Furthermore, such SNPs and their encoded products are useful targets for the development of therapeutic agents.

A large number of colorectal cancer-associated SNPs have been identified by genotyping DNA from 4,669 individuals, 2,373 of these individuals having been previously diagnosed with colorectal cancer and 2,296 being "control" or individuals thought to be free of colorectal cancer.

The present invention thus provides individual SNPs associated with colorectal cancer, genomic sequences (SEQ ID NOs:1761 to 1790) containing SNPs, and transcript sequences amino acid sequences. The invention includes methods of detecting these polymorphisms in a test sample, methods of determining the risk of an individual of having or developing colorectal cancer, methods of screening for compounds useful for treating disorders associated with a variant gene/protein such as colorectal cancer, compounds identified by these screening methods, methods of using the disclosed SNPs to select a treatment strategy, methods of treating a disorder associated with a variant gene/protein (i.e., therapeutic methods), and methods of using the SNPs of the present invention for human identification.

When the presence in the genome of an individual of a particular base, e.g., adenine, at a particular location in the genome correlates with an increased probability of that individual contracting colorectal cancer vis-à-vis a population not having that base at that location in the genome, that individual is said to be at "increased risk" of contracting colorectal cancer, i.e., to have an increased susceptibility. In certain cases, this effect can be a "dominant" effect in which case such increased probability exists when the base is present in one or the other or both alleles of the individual. In certain cases, the effect can be said to be "recessive", in which case such increased probability exists only when the base is present in both alleles of the individual.

When the presence in the genome of an individual of a particular base, e.g., adenine, at a particular location in the genome decreases the probability of that individual contracting colorectal cancer vis-à-vis a population not having that base at that location in the genome, that individual is said to be at "decreased risk" of contracting colorectal cancer, i.e., to have a decreased susceptibility. Such an allele is sometimes referred to in the art as being "protective". As with increased risk, it is also possible for a decreased risk to be characterized as dominant or recessive.

An "altered risk" means either an increased or a decreased risk.

The genetic analysis detailed below linked colorectal cancer with SNPs in the human genome. A SNP is a particular type of polymorphic site, a polymorphic site being a region in a nucleic acid sequence at which two or more alternative nucleotides are observed in a significant number of individuals from a population. A polymorphic site may be a nucleotide sequence of two or more nucleotides, an inserted nucleotide or nucleotide sequence, a deleted nucleotide or nucleotide sequence, or a microsatellite, for example. A polymorphic site that is two or more nucleotides in length may be 3, 4, 5, 6, 7, 8, 9, 10, 11, 12, 13, 14, 15 or more, 20 or more, 30 or more, 50 or more, 75 or more, 100 or more, 500 or more, or about 1000 nucleotides in length, where all or some of the nucleotide sequences differ within the region. Each of the specific polymorphic sites found in SEQ ID NOs:1761 to 1790 is a "single nucleotide polymorphism" or a "SNP."

Where there are two, three, or four alternative nucleotide sequences at a polymorphic site, each nucleotide sequence is referred to as a "polymorphic variant" or "nucleic acid variant." Where two polymorphic variants exist, for example, the polymorphic variant represented in a majority of samples from a population is sometimes referred to as a "prevalent allele" and the polymorphic variant that is less prevalently represented is sometimes referred to as an "uncommon allele." An individual who possesses two prevalent alleles or two uncommon alleles is "homozygous" with respect to the polymorphism, and an individual who possesses one prevalent allele and one uncommon allele is "heterozygous" with respect to the polymorphism. Individuals who are homozygous with respect to one allele are sometimes predisposed to a different phenotype as compared to individuals who are heterozygous or homozygous with respect to another allele.

A genotype or polymorphic variant may also be expressed in terms of a "haplotype," which refers to the identity of two or more polymorphic variants occurring within genomic DNA on the same strand of DNA. For example, two SNPs may exist within a gene where each SNP position may include a cytosine variation or an adenine variation. Certain individuals in a population may carry an allele (heterozygous) or two alleles (homozygous) having the gene with a cytosine at each SNP position. As the two cytosines corresponding to each SNP in the gene travel together on one or both alleles in these individuals, the individuals can be characterized as having a cytosine/cytosine haplotype with respect to the two SNPs in the gene.

A "phenotype" is a trait which can be compared between individuals, such as presence or absence of a condition, for example, occurrence of colorectal cancer.

Polymorphic variants are often reported without any determination of whether the variant is represented in a significant fraction of a population. Some reported variants are sequencing errors and/or not biologically relevant. Thus, it is often not known whether a reported polymorphic variant is statistically significant or biologically relevant until the presence of the variant is detected in a population of individuals and the frequency of the variant is determined.

A polymorphic variant may be detected on either or both strands of a double-stranded nucleic acid. Also, a polymorphic variant may be located within an intron or exon of a gene or within a portion of a regulatory region such as a promoter, a 5' untranslated region (UTR), a 3' UTR, and in DNA (e.g., genomic DNA (gDNA) and complementary DNA (cDNA)), RNA (e.g., mRNA, tRNA, and rRNA), or a polypeptide. Polymorphic variations may or may not result in detectable differences in gene expression, polypeptide structure, or polypeptide function.

In our genetic analysis associating colorectal cancer with the polymorphic variants set forth in the tables, samples from individuals having been diagnosed with colorectal cancer and individuals not having cancer were allelotyped and genotyped. The allele frequency for each polymorphic variant among cases and controls was determined. These allele frequencies were compared in cases and controls, or combinations. Particular SNPs were thus found to be associated with colorectal cancer when genotype and haplotype frequency differences calculated between case and control pools were established to be statistically significant.

As mentioned above, polymorphic variants can travel together. Such variants are said to be in "linkage disequilibrium" so that heritable elements e.g., alleles that have a tendency to be inherited together instead of being inherited independently by random assortment are in linkage disequilibrium. Alleles are randomly assorted or inherited independently of each other if the frequency of the two alleles together is the product of the frequencies of the two alleles individually. For example, if two alleles at different polymorphic sites are present in 50% of the chromosomes in a population, then they would be said to assort randomly if the two alleles are present together on 25% of the chromosomes in the population. A higher percentage would mean that the two alleles are linked. For example, a first polymorphic site P1 having two alleles, e.g. A and C—each appearing in 50% of the individuals in a given population, is said to be in linkage disequilibrium with a second polymorphic site P2 having two alleles e.g. G and T—each appearing in 50% of the individuals in a given population, if particular combinations of alleles are observed in individuals at a frequency greater than 25% (if the polymorphic sites are not linked, then one would expect a 50% chance of an individual having A at P1 and a 50% chance of having G at P2 thus leading to a 25% chance of having the combination of A at P1 and G at P2 together). Heritable elements that are in linkage disequilibrium are said to be "linked" or "genetically linked" to each other.

One can see that in the case of a group of SNPs that are in linkage disequilibrium with each other, knowledge of the existence of all such SNPs in a particular individual generally provides redundant information. Thus, when identifying an individual who has an altered risk for developing colorectal cancer according to this invention, it is necessary to detect only one SNP of such a group of SNPs associated with an altered risk of developing colorectal cancer.

It has been shown that each SNP in the genomic sequences identified as SEQ ID NOs:1761 to 1790 is associated with the occurrence of colorectal cancer. Thus, featured herein are methods for identifying a risk of colorectal cancer in a subject, which includes detecting the presence or absence of one or more of the SNPs described herein in a human nucleic acid sample.

Three different analyses were performed for each marker: (a) a test of trend across the 3 genotypes (Sasieni et al. 1997); (b) a dominant model where the homozygous genotype for allele "B" is combined with the prevalent heterozygote genotype; and (c) a recessive model where the homozygous genotype for allele "A" is combined with the heterozygous genotype. Using permutation analysis, the empirical p-value for the maximum of these three test statistics was calculated. Odds ratios measuring the strength of the association are also reported for the model corresponding to the largest of the three test statistics.

Pertinent results for each SNP are summarized in the tables: Chromosomal number and position-using the International Human Genome Sequencing Consortium build 35 (http://www.ncbi.nlm.nih.gov/genome/seq/) as made available by the National Center for Biotechnology Information (NCBI), National Library of Medicine, Building 38A, Bethesda, Md. 20894 U.S.A., gene marker name-using the nomenclature of the NCBI dbSNP (http://www.ncbi.nlm.nih.gov/SNP/) and gene name-using the unigene naming convention. Under the "Case Flag" the number 1 designates Cases and the number 0 designates Controls. The identity of the base designated "A" in the analysis is indicated where 1=A (adenine), 2=C (cytosine), 3=G (guanine) and 4=T (thymidine). "B" indicates the polymorphic allele. AA, AB, BB are the counts of the number of individuals with the given genotype, by cases/controls. For dominant models, an odds ratio measuring the increase in risk associated with one or two copies of allele B is calculated. For recessive models, an odds ratio associated with exactly two copies of allele B is calculated. For the trend models, the Mantel-Haenszel odds ratio showing the increase in risk with each additional copy of allele B is calculated.

It has been discovered that each polymorphic variation in the genomic sequences identified as SEQ ID NOs:1761 to 1790 is associated with the occurrence of colorectal cancer. Thus, featured herein are methods for identifying a risk of colorectal cancer in a subject, which comprises detecting the presence or absence of one or more of the polymorphic variations described herein in a human nucleic acid sample. The polymorphic variation, SNP, are detailed in the tables.

Methods for determining whether a subject is susceptible to, i.e., at risk of colorectal cancer are provided herein. These methods include detecting the presence or absence of one or more polymorphic variations, i.e., SNPs, associated with colorectal cancer in a sample from a subject.

SNPs can be associated with a disease state in humans or in animals. The association can be direct, as in conditions where the substitution of a base results in alteration of the protein coding sequence of a gene which contributes directly to the pathophysiology of the condition. Common examples of this include diseases such as sickle cell anemia and cystic fibrosis. The association can be indirect when the SNP plays no role in the disease, but is located close to the defective gene such that there is a strong association between the presence of the SNP and the disease state. Because of the high frequency of SNPs within the genome, there is a greater probability that a SNP will be linked to a genetic locus of interest than other types of genetic markers.

Disease-associated SNPs can occur in coding and non-coding regions of the genome. When located in the coding region altered function of the ensuing protein sequence may occur. If it occurs in the regulatory region of a gene it may affect expression of the protein. If the protein is involved in protecting the body against pathological conditions this can result in disease susceptibility.

Numerous methods exist for the measurement of specific SNP genotypes. Individuals carrying mutations in one or more SNPs of the present invention may be detected at the DNA level by a variety of techniques. Nucleic acids for diagnosis may be obtained from a patient's cells, such as from blood, urine, saliva, tissue biopsy and autopsy material.

The genomic DNA may be used directly for detection or may be amplified enzymatically by using PCR prior to analysis (Saiki et al., 1986). RNA or cDNA may also be used in the same ways. As an example, PCR primers complementary to the nucleic acid of one or more SNPs of the present invention can be used to identify and analyze the presence or absence of the SNP. For example, deletions and insertions can be detected by a change in size of the amplified product in comparison to the normal genotype. Point mutations can be identified by hybridizing amplified DNA to radiolabeled SNP RNA of the present invention or alternatively, radiolabeled SNP antisense DNA sequences of the present invention. Perfectly matched sequences can be distinguished from mismatched duplexes by RNase A digestion or by differences in melting temperatures.

Sequence differences between a reference gene and genes having mutations also may be revealed by direct DNA sequencing. In addition, cloned DNA segments may be employed as probes to detect specific DNA segments. The sensitivity of such methods can be greatly enhanced by appropriate use of PCR or another amplification method. For example, a sequencing primer is used with double-stranded PCR product or a single-stranded template molecule generated by a modified PCR. The sequence determination is performed by conventional procedures with radiolabeled nucleotide or by automatic sequencing procedures with fluorescent-tags.

Genetic testing based on DNA sequence differences may be achieved by detection of alteration in electrophoretic mobility of DNA fragments in gels, with or without denaturing agents. Small sequence deletions and insertions can be visualized by high resolution gel electrophoresis. DNA fragments of different sequences may be distinguished on denaturing formamide gradient gels in which the mobilities of different DNA fragments are retarded in the gel at different positions according to their specific melting or partial melting temperatures (Myers et al., 1985).

Sequence changes at specific locations also may be revealed by nuclease protection assays, such as RNase and S1 protection or the chemical cleavage method (Cotton et al., 1988).

Thus, the detection of a specific DNA sequence may be achieved by methods which include, but are not limited to, hybridization, RNase protection, chemical cleavage, direct DNA sequencing or the use of restriction enzymes, (e.g., restriction fragment length polymorphisms ("RFLP") and Southern blotting of genomic DNA).

In addition to more conventional gel-electrophoresis and DNA sequencing, mutations also can be detected by in situ analysis.

Genetic mutations can be identified by hybridizing a sample and control nucleic acids, e.g., DNA or RNA, to high density arrays containing hundreds or thousands of oligonucleotide probes (Cronin et al., 1996; Kozal et al., 1996). For example, genetic mutations can be identified in two-dimensional arrays containing light-generated DNA probes as described in Cronin et al., supra. Briefly, a first hybridization array of probes can be used to scan through long stretches of DNA in a sample and control to identify base changes between the sequences by making linear arrays of sequential overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene. Specific mutations can also be determined through direct sequencing of one or both strands of DNA using dideoxy nucleotide chain termination chemistry, electrophoresis through a semi-solid matrix and fluorescent or radioactive chain length detection techniques. Further mutation detection techniques may involve differential susceptibility of the polymorphic double strand to restriction endonuclease digestion, or altered electrophoretic gel mobility of single or double stranded gene fragments containing one polymorphic form. Other techniques to detect specific DNA polymorphisms or mutation may involve evaluation of the structural characteristics at the site of polymorphism using nuclear magnetic resonance or x-ray diffraction techniques.

These genetic tests are useful for prognosing and/or diagnosing colorectal cancer and often are useful for determining whether an individual is at an increased or decreased risk of developing or having colorectal cancer.

Thus, the invention includes a method for identifying a subject at risk of colorectal cancer, which includes detecting in a nucleic acid sample from the subject the presence or absence of a SNP associated with colorectal cancer at a polymorphic site in a nucleotide sequence identified as SEQ ID NOs:1 to 1790.

Results from prognostic tests may be combined with other test results to diagnose colorectal cancer. For example, prognostic results may be gathered, a patient sample may be ordered based on a determined predisposition to colorectal cancer, the patient sample analyzed, and the results of the analysis may be utilized to diagnose colorectal cancer. Also colorectal cancer diagnostic methods can be developed from studies used to generate prognostic/diagnostic methods in which populations are stratified into subpopulations having different progressions of colorectal cancer. In another embodiment, prognostic results may be gathered; a patient's risk factors for developing colorectal cancer analyzed (e.g., age, family history); and a patient sample may be ordered based on a determined predisposition to colorectal cancer. In an alternative embodiment, the results from predisposition analyses may be combined with other test results indicative of colorectal cancer, which were previously, concurrently, or subsequently gathered with respect to the predisposition testing. In these embodiments, the combination of the prognostic test results with other test results can be probative of colorectal cancer, and the combination can be utilized as a colorectal cancer diagnostic.

Risk of colorectal cancer sometimes is expressed as a probability, such as an odds ratio, percentage, or risk factor. The risk is based upon the presence or absence of one or more of the SNP variants described herein, and also may be based in part upon phenotypic traits of the individual being tested. Methods for calculating risk based upon patient data are well known (Agresti, 2001). Allelotyping and genotyping analyses may be carried out in populations other than those exemplified herein to enhance the predictive power of the prognostic method. These further analyses are executed in view of the exemplified procedures described herein, and may be based upon the same polymorphic variations or additional polymorphic variations. Risk determinations for colorectal cancer are useful in a variety of applications. In one embodiment, colorectal cancer risk determinations are used by clinicians to direct appropriate detection, preventative and treatment procedures to subjects who most require these. In another embodiment, colorectal cancer risk determinations are used by health insurers for preparing actuarial tables and for calculating insurance premiums.

The nucleic acid sample typically is isolated from a biological sample obtained from a subject. For example, nucleic acid can be isolated from blood, saliva, sputum, urine, cell scrapings, and biopsy tissue. The nucleic acid sample can be isolated from a biological sample using standard techniques. The nucleic acid sample may be isolated from the subject and then directly utilized in a method for determining the presence of a polymorphic variant, or alternatively, the sample may be isolated and then stored (e.g., frozen) for a period of time before being subjected to analysis.

The presence or absence of a polymorphic variant is determined using one or both chromosomal complements represented in the nucleic acid sample. Determining the presence or absence of a polymorphic variant in both chromosomal complements represented in a nucleic acid sample is useful for determining the zygosity of an individual for the polymorphic variant (i.e., whether the individual is homozygous or heterozygous for the polymorphic variant). Any oligonucleotide-based diagnostic may be utilized to determine whether a sample includes the presence or absence of a polymorphic variant in a sample. For example, primer extension methods, ligase sequence determination methods (e.g., U.S. Pat. Nos. 5,679,524 and 5,952,174, and WO 01/27326), mismatch sequence determination methods (e.g., U.S. Pat. Nos. 5,851, 770; 5,958,692; 6,110,684; and 6,183,958), microarray sequence determination methods, restriction fragment length polymorphism (RFLP), single strand conformation polymorphism detection (SSCP) (e.g., U.S. Pat. Nos. 5,891,625 and 6,013,499), PCR-based assays (e.g., TAQMAN™ PCR System (Applied Biosystems)), and nucleotide sequencing methods may be used.

Oligonucleotide extension methods typically involve providing a pair of oligonucleotide primers in a polymerase chain reaction (PCR) or in other nucleic acid amplification methods for the purpose of amplifying a region from the nucleic acid sample that comprises the polymorphic variation. One oligonucleotide primer is complementary to a region 3' of the polymorphism and the other is complementary to a region 5' of the polymorphism. A PCR primer pair may be used in methods disclosed in U.S. Pat. Nos. 4,683, 195; 4,683,202; 4,965,188; 5,656,493; 5,998,143; 6,140,054; WO 01/27327; and WO 01/27329 for example. PCR primer pairs may also be used in any commercially available machines that perform PCR, such as any of the GENE-AMP™, systems available from Applied Biosystems. Also, those of ordinary skill in the art will be able to design oligonucleotide primers based upon the nucleotide sequences set forth in SEQ ID NOs:1 to 1790.

Also provided is an extension oligonucleotide that hybridizes to the amplified fragment adjacent to the polymorphic variation. An adjacent fragment refers to the 3' end of the extension oligonucleotide being often 1 nucleotide from the 5' end of the polymorphic site, and sometimes 2, 3, 4, 5, 6, 7, 8, 9, or 10 nucleotides from the 5' end of the polymorphic site, in the nucleic acid when the extension oligonucleotide is hybridized to the nucleic acid. The extension oligonucleotide then is extended by one or more nucleotides, and the number and/or type of nucleotides that are added to the extension oligonucleotide determine whether the polymorphic variant is present. Oligonucleotide extension methods are disclosed, for example, in U.S. Pat. Nos. 4,656,127; 4,851,331; 5,679, 524; 5,834,189; 5,876,934; 5,908,755; 5,912,118; 5,976,802; 5,981,186; 6,004,744; 6,013,431; 6,017,702; 6,046,005; 6,087,095; 6,210,891; and WO 01/20039. Oligonucleotide extension methods using mass spectrometry are described, for example, in U.S. Pat. Nos. 5,547,835; 5,605,798; 5,691, 141; 5,849,542; 5,869,242; 5,928,906; 6,043,031; and 6,194, 144. Multiple extension oligonucleotides may be utilized in one reaction, which is referred to as multiplexing.

A microarray can be utilized for determining whether a SNP is present or absent in a nucleic acid sample. A microarray may include any oligonucleotides described herein, and methods for making and using oligonucleotide microarrays suitable for diagnostic use are disclosed in U.S. Pat. Nos. 5,492,806; 5,525,464; 5,589,330; 5,695,940; 5,849,483; 6,018,041; 6,045,996; 6,136,541; 6,142,681; 6,156,501; 6,197,506; 6,223,127; 6,225,625; 6,229,911; 6,239,273; WO 00/52625; WO 01/25485; and WO 01/29259. The microarray typically comprises a solid support and the oligonucleotides may be linked to this solid support by covalent bonds or by non-covalent interactions. The oligonucleotides may also be linked to the solid support directly or by a spacer molecule. A microarray may comprise one or more oligonucleotides complementary to a SNP set forth in the tables.

A kit also may be utilized for determining whether a polymorphic variant is present or absent in a nucleic acid sample. A kit can include one or more pairs of oligonucleotide primers useful for amplifying a fragment of a nucleotide sequence of interest, where the fragment includes a polymorphic site. The kit sometimes comprises a polymerizing agent, for example, a thermo-stable nucleic acid polymerase such as one disclosed in U.S. Pat. No. 4,889,818 or 6,077,664. Also, the kit often comprises an elongation oligonucleotide that hybridizes to the nucleotide sequence in a nucleic acid sample adjacent to the polymorphic site. Where the kit includes an elongation oligonucleotide, it can also include chain elongating nucleotides, such as dATP, dTTP, dGTP, dCTP, and dITP, including analogs of dATP, dTTP, dGTP, dCTP and dITP, provided that such analogs are substrates for a thermo-stable nucleic acid polymerase and can be incorporated into a nucleic acid chain elongated from the extension oligonucleotide. Along with chain elongating nucleotides would be one or more chain terminating nucleotides such as ddATP, ddTTP, ddGTP, ddCTP. The kit can include one or more oligonucleotide primer pairs, a polymerizing agent, chain elongating nucleotides, at least one elongation oligonucleotide, and one or more chain terminating nucleotides. Kits optionally include buffers, vials, microtiter plates, and instructions for use.

An individual identified as being susceptible to colorectal cancer may be heterozygous or homozygous with respect to the allele associated with an increased risk of colorectal cancer, as indicated in the tables. A subject homozygous for an allele associated with an increased risk of colorectal cancer is at a comparatively high risk of colorectal cancer as far as that SNP is concerned whether or not the allelic effect has been determined to be dominant or recessive. A subject who is heterozygous for an allele associated with an increased risk of colorectal cancer, in which the allelic effect is recessive would likely be at a comparatively reduced risk of colorectal cancer predicted by that SNP.

Individuals carrying mutations in one or more SNP of the present invention may be detected at the protein level by a variety of techniques. Cells suitable for diagnosis may be obtained from a patient's blood, urine, saliva, tissue biopsy and autopsy material.

Also featured are methods for determining risk of colorectal cancer and/or identifying a subject at risk of colorectal cancer by contacting a polypeptide or protein encoded by a nucleotide sequence from a subject with an antibody that specifically binds to an epitope associated with an altered, usually increased risk of colorectal cancer in the polypeptide.

Isolated Nucleic Acids

Oligonucleotides can be linked to a second moiety, which can be another nucleic acid molecule to provide, for example, a tail sequence (e.g., a polyadenosine tail), an adapter sequence (e.g., phage M13 universal tail sequence), etc. Alternatively, the moiety might be one that facilitates linkage to a solid support or a detectable label, e.g., a radioactive label, a fluorescent label, a chemiluminescent label, a paramagnetic label, etc.

Nucleic acid sequences shown in the tables can be used for diagnostic purposes for detection and control of polypeptide expression. Also, oligonucleotide sequences such as antisense RNA, small-interfering RNA (siRNA) and DNA molecules and ribozymes that function to inhibit translation of a polypeptide are part of this invention.

Antisense RNA and DNA molecules, siRNA and ribozymes can be prepared by known methods. These include techniques for chemically synthesizing oligodeoxyribonucleotides such as solid phase phosphoramidite chemical synthesis. Alternatively, RNA molecules may be generated by in vitro and in vivo transcription of DNA sequences encoding the antisense RNA molecule. Such DNA sequences can be incorporated into vectors which incorporate suitable RNA polymerase promoters such as the T7 or SP6 polymerase promoters, or antisense cDNA constructs that synthesize antisense RNA constitutively or inducibly, depending on the promoter used, can be introduced stably into cell lines.

DNA encoding a polypeptide can also be used in the diagnosis of colorectal cancer, resulting from aberrant expression of a target gene. For example, the nucleic acid sequence can be used in hybridization assays of biopsies or autopsies to diagnose abnormalities of expression or function (e.g., Southern or Northern blot analysis, in situ hybridization assays).

Expression of a polypeptide during embryonic development can also be determined using nucleic acid encoding the polypeptide, particularly production of a functionally impaired polypeptide that is the cause of colorectal cancer. In situ hybridizations using a polypeptide as a probe can be employed to predict problems related to colorectal cancer. Administration of human active polypeptide, recombinantly produced can be used to treat disease states related to functionally impaired polypeptide. Alternatively, gene therapy approaches may be employed to remedy deficiencies of functional polypeptide or to replace or compete with a dysfunctional polypeptide.

Included as part of this invention are nucleic acid vectors, often expression vectors, which contain a nucleotide sequence set forth in the tables. A vector is a nucleic acid molecule capable of transporting another nucleic acid to which it has been linked and can include a plasmid, cosmid, or viral vector. The vector can be capable of autonomous replication or it can integrate into a host DNA. Viral vectors may include replication defective retroviruses, adenoviruses and adeno-associated viruses for example.

A vector can include a nucleotide sequence from the tables in a form suitable for expression of an encoded protein or nucleic acid in a host cell. The recombinant expression vector generally includes one or more regulatory sequences operatively linked to the nucleic acid sequence to be expressed. A regulatory sequence includes promoters, enhancers and other expression control elements (e.g., polyadenylation signals). Regulatory sequences include those that direct constitutive expression of a nucleotide sequence, as well as tissue-specific regulatory and/or inducible sequences. The design of the expression vector can depend on such factors as the choice of the host cell to be transformed, the level of expression of polypeptide desired, etc. Expression vectors can be introduced into host cells to produce the desired polypeptides, including fusion polypeptides.

Recombinant expression vectors can be designed for expression of polypeptides in prokaryotic or eukaryotic cells. For example, the polypeptides can be expressed in E. coli, insect cells (e.g., using baculovirus expression vectors), yeast cells, or mammalian cells. Suitable host cells are discussed further by Goeddel (Goeddel, 1990). A recombinant expression vector can also be transcribed and translated in vitro, for example using T7 promoter regulatory sequences and T7 polymerase.

Expression of polypeptides in prokaryotes can be carried out in E. coli with vectors containing constitutive or inducible promoters directing the expression of either fusion or non-fusion polypeptides. Fusion vectors add a number of amino acids to a polypeptide. Such fusion vectors typically serve to increase expression of recombinant polypeptide, to increase the solubility of the recombinant polypeptide and/or to aid in the purification of the recombinant polypeptide by acting as a ligand during purification. Often, a proteolytic cleavage site is introduced at the junction of the fusion moiety and the recombinant polypeptide to enable separation of the recombinant polypeptide from the fusion moiety after purification of the fusion polypeptide. Such enzymes, and their cognate recognition sequences, include Factor Xa, thrombin and enterokinase. Typical fusion expression vectors include pGEX (Pharmacia Biotech Inc; (Smith & Johnson, 1988)), pMAL (New England Biolabs, Beverly, Mass.) and pRIT5 (Pharmacia, Piscataway, N.J.) which fuse glutathione S-transferase (GST), maltose E binding polypeptide, or polypeptide A, respectively, to the target recombinant polypeptide.

Purified fusion polypeptides can be used in screening assays and to generate antibodies specific for polypeptides. In a therapeutic embodiment, fusion polypeptide expressed in a retroviral expression vector can be used to infect bone marrow cells that are subsequently transplanted into irradiated recipients. The pathology of the subject recipient is then examined after sufficient time has passed.

Expressing a polypeptide in host bacteria with an impaired capacity to proteolytically cleave the recombinant polypeptide can be used to maximize recombinant polypeptide expression (Gottesman, 1990). The nucleotide sequence of the nucleic acid to be inserted into an expression vector can be changed so that the individual codons for each amino acid are those preferentially utilized in E. coli (Wada et al., 1992).

When used in mammalian cells, the expression vector's control functions are often provided by viral regulatory elements. For example, commonly used promoters are derived from polyoma, Adenovirus 2, cytomegalovirus and Simian Virus 40. Recombinant mammalian expression vectors can be capable of directing expression of the nucleic acid in a particular cell type (e.g., tissue-specific regulatory elements are used to express the nucleic acid). Examples of suitable tissue-specific promoters include an albumin promoter (Pinkert et al., 1987), lymphoid-specific promoters (Calame and Eaton, 1988), promoters of immunoglobulins (Banerji et al., 1983; Queen and Baltimore, 1983), neuron-specific promoters (Byrne and Ruddle, 1989), pancreas-specific promoters (Edlund et al., 1985), and mammary gland-specific promoters (e.g., milk whey promoter; U.S. Pat. No. 4,873,316 and European Application Publication No. 264,166). Developmentally-regulated promoters are sometimes utilized, for example, the murine hox promoters (Kessel and Gruss, 1990) and the .alpha.-fetopolypeptide promoter (Camper and Tilghman, 1989).

A nucleic acid from one of the tables might be cloned into an expression vector in an antisense orientation. Regulatory sequences (e.g., viral promoters and/or enhancers) operatively linked to a nucleic acid cloned in the antisense orientation can be chosen for directing constitutive, tissue specific or cell type specific expression of antisense RNA in a variety of cell types. Antisense expression vectors can be in the form of a recombinant plasmid, phagemid or attenuated virus.

The invention includes host cells having a nucleotide sequence from the tables within a recombinant expression vector or a fragment of such a sequence, which facilitate homologous recombination into a specific site of the host cell genome. Terms such as host cell and recombinant host cell refer not only to the particular subject cell but also to the progeny of a cell. Because certain modifications may occur in succeeding generations due to either mutation or environmental influences, such progeny may not, in fact, be identical to the parent cell. A host cell can be any prokaryotic or eukaryotic cell. For example, a polypeptide can be expressed in bacterial cells such as E. coli, insect cells, yeast or mammalian cells (such as Chinese hamster ovary cells (CHO) or COS cells).

Vectors can be introduced into host cells via conventional transformation or transfection techniques. The terms transformation and transfection refer to a variety of techniques known for introducing foreign nucleic acid (e.g., DNA) into a host cell, including calcium phosphate or calcium chloride co-precipitation, transduction/infection, DEAE-dextran-mediated transfection, lipofection, or electroporation.

A host cell can be used to produce a polypeptide. Accordingly, methods for producing a polypeptide using the host cells are included as part of this invention. Such a method can include culturing host cells into which a recombinant expression vector encoding a polypeptide has been introduced in a suitable medium such that the polypeptide is produced. The method can further include isolating the polypeptide from the medium or the host cell.

The invention also includes cells or purified preparations of cells which include a transgene from the tables, or which otherwise mis-express a polypeptide. Cell preparations can consist of human or non-human cells, e.g., rodent cells, e.g., mouse or rat cells, rabbit cells, or pig cells. The transgene can be mis-expressed, e.g., over-expressed or under-expressed. In other embodiments, the cell or cells include a gene which misexpresses an endogenous polypeptide (e.g., expression of a gene is disrupted, also known as a knockout). Such cells can serve as a model for studying disorders which are related to mutated or mis-expressed alleles or for use in drug screening. Also provided are human cells (e.g., hematopoietic stem cells) transformed with a nucleic acid from the tables.

The invention includes cells or a purified preparation thereof (e.g., human cells) in which an endogenous nucleic acid from the tables is under the control of a regulatory sequence that does not normally control the expression of the endogenous gene corresponding to the sequence. The expression characteristics of an endogenous gene within a cell (e.g., a cell line or microorganism) can be modified by inserting a heterologous DNA regulatory element into the genome of the cell such that the inserted regulatory element is operably linked to the corresponding endogenous gene. For example, an endogenous corresponding gene (e.g., a gene which is transcriptionally silent, not normally expressed, or expressed only at very low levels) may be activated by inserting a regulatory element which is capable of promoting the expression of a normally expressed gene product in that cell. Techniques such as targeted homologous recombinations, can be used to insert the heterologous DNA as described in, e.g., Chappel, U.S. Pat. No. 5,272,071; WO 91/06667, published on May 16, 1991.

Non-human transgenic animals that express a heterologous polypeptide (e.g., expressed from a nucleic acid from the tables) can be generated. Such animals are useful for studying the function and/or activity of a polypeptide and for identifying and/or evaluating modulators of the activity of the nucleic acids and encoded polypeptides. A transgenic animal is a non-human animal such as a mammal (e.g., a non-human primate such as chimpanzee, baboon, or macaque; an ungulate such as an equine, bovine, or caprine; or a rodent such as a rat, a mouse, or an Israeli sand rat), a bird (e.g., a chicken or a turkey), an amphibian (e.g., a frog, salamander, or newt), or an insect (e.g., *Drosophila melanogaster*), in which one or more of the cells of the animal includes a transgene. A transgene is exogenous DNA or a rearrangement (e.g., a deletion of endogenous chromosomal DNA) that is often integrated into or occurs in the genome of cells in a transgenic animal. A transgene can direct expression of an encoded gene product in one or more cell types or tissues of the transgenic animal. Thus, a transgenic animal can be one in which an endogenous nucleic acid homologous to a nucleic acid from the tables has been altered by homologous recombination between the endogenous gene and an exogenous DNA molecule introduced into a cell of the animal (e.g., an embryonic cell of the animal) prior to development of the animal.

Intronic sequences and polyadenylation signals can also be included in the transgene to increase expression efficiency of the transgene. One or more tissue-specific regulatory sequences can be operably linked to a nucleotide sequence from the tables to direct expression of an encoded polypeptide to particular cells. A transgenic founder animal can be identified based upon the presence of the nucleotide sequence in its genome and/or expression of encoded mRNA in tissues or cells of the animals. A transgenic founder animal can then be used to breed additional animals carrying the transgene. Moreover, transgenic animals carrying a nucleotide sequence can further be bred to other transgenic animals carrying other transgenes.

Polypeptides can be expressed in transgenic animals or plants by introducing a nucleic acid encoding the polypeptide into the genome of an animal. In certain embodiments the nucleic acid is placed under the control of a tissue specific promoter, e.g., a milk or egg specific promoter, and recovered from the milk or eggs produced by the animal. Also included is a population of cells from a transgenic animal.

Isolated polypeptides encoded by a nucleotide sequence from the tables can be synthesized. Isolated polypeptides include both the full-length polypeptide and the mature polypeptide (i.e., the polypeptide minus the signal sequence or propeptide domain). An isolated, or purified, polypeptide or protein is substantially free of cellular material or other contaminating proteins from the cell or tissue source from which the protein is derived, or is substantially free from chemical precursors or other chemicals when chemically synthesized. Substantially free means a preparation of a polypeptide having less than about 5% (by dry weight) of contaminating protein, or of chemical precursors or non-target chemicals. When the desired polypeptide is recombinantly produced, it is typically substantially free of culture medium, specifically, where culture medium represents less than about 10% of the polypeptide preparation.

Also, polypeptides may exist as chimeric or fusion polypeptides. As used herein, a "target chimeric polypeptide" or "target fusion polypeptide" includes a target polypeptide linked to a different polypeptide. The target polypeptide in the fusion polypeptide can correspond to an entire or nearly entire polypeptide as it exists in nature or a fragment thereof. The other polypeptide can be fused to the N-terminus or C-terminus of the target polypeptide.

Fusion polypeptides can include a moiety having high affinity for a ligand. For example, the fusion polypeptide can be a GST-target fusion polypeptide in which the target sequences are fused to the C-terminus of the GST sequences, or a polyhistidine-target fusion polypeptide in which the target polypeptide is fused at the N- or C-terminus to a string of histidine residues. Such fusion polypeptides can facilitate purification of recombinant target polypeptide. Expression vectors are commercially available that already encode a fusion moiety (e.g., a GST polypeptide), and a nucleotide sequence from the tables, or a substantially identical nucleotide sequence thereof, can be cloned into an expression vector such that the fusion moiety is linked in-frame to the target polypeptide. Further, the fusion polypeptide can be a target polypeptide containing a heterologous signal sequence at its N-terminus. In certain host cells (e.g., mammalian host cells), expression, secretion, cellular internalization, and cellular localization of a target polypeptide can be increased through use of a heterologous signal sequence. Fusion polypeptides can also include all or a part of a serum polypeptide (e.g., an IgG constant region or human serum albumin).

Target polypeptides can be incorporated into pharmaceutical compositions and administered to a subject in vivo. Administration of these polypeptides can be used to affect the bioavailability of a substrate of the polypeptide and may effectively increase polypeptide biological activity in a cell. Target fusion polypeptides may be useful therapeutically for the treatment of disorders caused by, for example, (i) aberrant modification or mutation of a gene encoding a polypeptide; (ii) mis-regulation of the gene encoding the polypeptide; and (iii) aberrant post-translational modification of a polypeptide. Also, target polypeptides can be used as immunogens to produce anti-target antibodies in a subject, to purify the polypeptide ligands or binding partners, and in screening assays to identify molecules which inhibit or enhance the interaction of a polypeptide with a substrate.

Polypeptides can be differentially modified during or after translation, e.g., by glycosylation, acetylation, phosphorylation, amidation, derivatization by known protecting/blocking groups, proteolytic cleavage, linkage to an antibody molecule or other cellular ligand, etc. Any known modification including specific chemical cleavage by cyanogen bromide, trypsin, chymotrypsin, papain, V8 protease, $NaBH_4$; acetylation, formylation, oxidation, reduction; metabolic synthesis in the presence of tunicamycin; etc. may be used. Additional post-translational modifications include, for example, N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of prokaryotic host cell expression. The polypeptide fragments may also be modified with a detectable label, such as an enzymatic, fluorescent, isotopic or affinity label to allow for detection and isolation of the polypeptide.

Chemically modified derivatives of polypeptides that can provide additional advantages such as increased solubility, stability and circulating time of the polypeptide, or decreased immunogenicity (see e.g., U.S. Pat. No. 4,179,337) are also part of this invention. The chemical moieties for derivitization may be selected from water soluble polymers such as polyethylene glycol, ethylene glycol/propylene glycol copolymers, carboxymethylcellulose, dextran, polyvinyl alcohol and the like. The polypeptides may be modified at random positions within the molecule, or at predetermined positions within the molecule and may include one, two, three or more attached chemical moieties.

The polymer may be of any molecular weight, and may be branched or unbranched. For polyethylene glycol, the molecular weight often is between about 1 kDa and about 100 kDa for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog).

The polymers can be attached to the polypeptide with consideration of effects on functional or antigenic domains of the polypeptide. There are a number of attachment methods available to those skilled in the art (e.g., EP 0 401 384 (coupling PEG to G-CSF) and Malik et al. (Malik et al., 1992) For example, polyethylene glycol may be covalently bound through amino acid residues via a reactive group, such as a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues, glutamic acid residues and the C-terminal amino acid residue. Sulfhydryl groups may also be used as a reactive group for attaching the polyethylene glycol molecules. For therapeutic purposes, the attachment sometimes is at an amino group, such as attachment at the N-terminus or lysine group.

Proteins can be chemically modified at the N-terminus. Using polyethylene glycol, for example, one may select from a variety of polyethylene glycol molecules (by molecular weight, branching, and the like), the proportion of polyethylene glycol molecules to protein (polypeptide) molecules in the reaction mix, the type of pegylation reaction to be performed, and the method of obtaining the selected N-terminally pegylated protein. The method of obtaining the N-terminally pegylated preparation (i.e., separating this moiety from other monopegylated moieties if necessary) may be by purification of the N-terminally pegylated material from a population of pegylated protein molecules. Selective proteins chemically modified at the N-terminus may be accomplished by reductive alkylation, which exploits differential reactivity of different types of primary amino groups (lysine versus the N-terminal) available for derivatization in a particular protein. Under the appropriate reaction conditions, substantially selective derivatization of the protein at the N-terminus with a carbonyl group containing polymer is achievable.

Applications of Prognostic and Diagnostic Results to Pharmacogenomic Methods

Pharmacogenomics is a discipline that involves tailoring a treatment for a subject according to the subject's genotype. For example, based upon the outcome of a prognostic test, a clinician or physician may target pertinent information and preventative or therapeutic treatments to a subject who would be benefited by the information or treatment and avoid directing such information and treatments to a subject who would not be benefited (e.g., the treatment has no therapeutic effect and/or the subject experiences adverse side effects). As therapeutic approaches for colorectal cancer continue to evolve and improve, the goal of treatments for colorectal cancer related disorders is to intervene even before clinical signs manifest themselves. Thus, genetic markers associated with susceptibility to colorectal cancer prove useful for early diagnosis, prevention and treatment of colorectal cancer.

The following is an example of a pharmacogenomic embodiment. A particular treatment regimen can exert a differential effect depending upon the subject's genotype. Where a candidate therapeutic exhibits a significant beneficial interaction with a prevalent allele and a comparatively weak interaction with an uncommon allele (e.g., an order of magnitude or greater difference in the interaction), such a therapeutic typically would not be administered to a subject genotyped as being homozygous for the uncommon allele, and sometimes not administered to a subject genotyped as being heterozygous for the uncommon allele. In another example, where a candidate therapeutic is not significantly toxic when administered to subjects who are homozygous for a prevalent allele but is comparatively toxic when administered to subjects heterozygous or homozygous for an uncommon allele, the candidate therapeutic is not typically administered to subjects who are genotyped as being heterozygous or homozygous with respect to the uncommon allele.

Methods of the invention are applicable to pharmacogenomic methods for detecting, preventing, alleviating and/or treating colorectal cancer. For example, a nucleic acid sample from an individual may be subjected to a genetic test. Where one or more SNPs associated with increased risk of colorectal cancer are identified in a subject, information for detecting, preventing or treating colorectal cancer and/or one or more colorectal cancer detection, prevention and/or treatment regimens then may be directed to and/or prescribed to that subject.

In certain embodiments, a detection, preventative and/or treatment regimen is specifically prescribed and/or administered to individuals who will most benefit from it based upon their risk of developing colorectal cancer assessed by the methods described herein. Methods are thus provided for identifying a subject at risk of colorectal cancer and then prescribing a detection, therapeutic or preventative regimen to individuals identified as being at increased risk of colorectal cancer. Thus, certain embodiments are directed to methods for treating colorectal cancer in a subject, reducing risk of colorectal cancer in a subject, or early detection of colorectal cancer in a subject, which comprise: detecting the presence or absence of a SNP associated with colorectal cancer in a nucleotide sequence set forth in SEQ ID NOs:1 to 1790, and prescribing or administering a colorectal cancer treatment regimen, preventative regimen and/or detection regimen to a subject from whom the sample originated where the presence of one or more SNPs associated with colorectal cancer are detected in the nucleotide sequence. In these methods, genetic results may be utilized in combination with other test results to diagnose colorectal cancer as described above.

The use of certain colorectal cancer treatments are known in the art, and include surgery, chemotherapy and/or radiation therapy. Any of the treatments may be used in combination to treat or prevent colorectal cancer (e.g., surgery followed by radiation therapy or chemotherapy).

Pharmacogenomic methods also may be used to analyze and predict a response to a colorectal cancer treatment or a drug. For example, if pharmacogenomic analysis indicates a likelihood that an individual will respond positively to a colorectal cancer treatment with a particular drug, the drug may be administered to the individual. Conversely, if the analysis indicates that an individual is likely to respond negatively to treatment with a particular drug, an alternative course of treatment may be prescribed. A negative response may be defined as either the absence of an efficacious response or the presence of toxic side effects. The response to a therapeutic treatment can be predicted in a background study in which subjects in any of the following populations are genotyped: a population that responds favorably to a treatment regimen, a population that does not respond significantly to a treatment regimen, and a population that responds adversely to a treatment regiment (e.g., exhibits one or more side effects). These populations are provided as examples and other populations and subpopulations may be analyzed. Based upon the results of these analyses, a subject is genotyped to predict whether he or she will respond favorably to a treatment regimen, not respond significantly to a treatment regimen, or respond adversely to a treatment regimen.

The methods described herein also are applicable to clinical drug trials. One or more SNPs indicative of response to an agent for treating colorectal cancer or to side effects to an agent for treating colorectal cancer may be identified. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems. Thus, another embodiment is a method of selecting an individual for inclusion in a clinical trial of a treatment or drug comprising the steps of: (a) obtaining a nucleic acid sample from an individual; (b) determining the identity of a polymorphic variant, e.g., SNP which is associated with a positive response to the treatment or the drug, or at least one SNP which is associated with a negative response to the treatment or the drug in the nucleic acid sample, and (c) including the individual in the clinical trial if the nucleic acid sample contains the SNP associated with a positive response to the treatment or the drug or if the nucleic acid sample lacks said SNP associated with a negative response to the treatment or the drug. The SNP may be in a sequence selected individually or in any combination from those disclosed in the tables. Step (c) can also include administering the drug or the treatment to the individual if the nucleic acid sample contains the SNP associated with a positive response to the treatment or the drug and the nucleic acid sample lacks the SNP associated with a negative response to the treatment or the drug.

Compositions Comprising Colorectal Cancer-Directed Molecules

The invention includes a composition made up of a colorectal cancer cell and one or more molecules specifically directed and targeted to a nucleic acid comprising a nucleotide sequence shown in the tables, or a polypeptide encoded thereby. Such directed molecules include, but are not limited to, a compound that binds to a nucleic acid or a polypeptide; a RNAi or siRNA molecule having a strand complementary to a nucleotide sequence; an antisense nucleic acid complementary to an RNA encoded by a DNA sequence; a ribozyme that hybridizes to a nucleotide sequence; a nucleic acid aptamer that specifically binds a polypeptide; and an antibody that specifically binds to a polypeptide or binds to a nucleic acid. In specific embodiments, the colorectal cancer directed molecule interacts with a nucleic acid or polypeptide variant associated with colorectal cancer.

Compounds

Compounds can be obtained using any of numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive (Zuckermann et al., 1994). Biological library and peptoid library approaches are typically limited to peptide libraries, while the other approaches are applicable to peptide, non-peptide oligomer or small molecule libraries of compounds (Lam, 1997). Examples of methods for synthesizing molecular libraries are described, for example, in DeWitt et al. (DeWitt et al., 1993), Erb et al. (Erb et al., 1994), Zuckermann et al. (Zuckermann et al., 1994), Cho et al. (Cho et al., 1993) and Gallop et al. (Gallop et al., 1994).

Libraries of compounds may be presented in solution (Houghten et al., 1992), or on beads (Lam et al., 1991), chips (Fodor et al., 1993), bacteria or spores (Ladner, U.S. Pat. No. 5,223,409), plasmids (Cull et al., 1992) or on phage (Scott and Smith, 1990; Devlin et al., 1990; Cwirla et al., 1990; Felici et al., 1991).

A compound sometimes alters expression and sometimes alters activity of a target polypeptide and may be a small molecule. Small molecules include peptides, peptidomimetics (e.g., peptoids), amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

An antisense nucleic acid refers to a nucleotide sequence complementary to a sense nucleic acid encoding a polypeptide, e.g., complementary to the, coding strand of a double-stranded cDNA molecule or complementary to an mRNA sequence. The antisense nucleic acid can be complementary to an entire coding strand in a nucleic acid molecule having a sequence of one of SEQ ID NOs:1761 to 1790, or to a portion thereof. In another embodiment, the antisense nucleic acid molecule is antisense to a non-coding region of the coding strand of a nucleotide sequence, e.g., 5' and 3' untranslated regions.

An antisense nucleic acid can be designed such that it is complementary to the entire coding region of an mRNA encoded by a nucleotide sequence of interest, and often the antisense nucleic acid is an oligonucleotide antisense to only a portion of a coding or non-coding region of the mRNA. For example, the antisense oligonucleotide can be complementary to the region surrounding the translation start site of the mRNA, e.g., between the −10 and +10 regions of the target gene nucleotide (SNP) sequence of interest. An antisense oligonucleotide can be, for example, about 7, 10, 15, 20, 25, 30, 35, 40, 45, 50, 55, 60, 65, 70, 75, 80, or more nucleotides in length. The antisense nucleic acids, which include the ribozymes described below, can be designed to target a nucleotide sequence in any of SEQ ID NOs:1761 to 1790. Uncommon alleles and prevalent alleles can be targeted, and those associated with an increased risk of colorectal cancer are often designed, tested, and administered to subjects.

An antisense nucleic acid can be constructed using chemical synthesis and enzymatic ligation reactions using standard procedures. For example, an antisense nucleic acid molecule can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Antisense nucleic acid also can be produced biologically using an expression vector into which a nucleic acid has been subcloned in an antisense orientation (i.e., RNA transcribed from the inserted nucleic acid will be of an antisense orientation to a target nucleic acid of interest.

When utilized as therapeutics, antisense nucleic acids typically are administered to a subject (e.g., by direct injection at a tissue site) or generated in situ such that they hybridize with or bind to cellular mRNA and/or genomic DNA encoding a polypeptide and thereby inhibit expression of the polypeptide, for example, by inhibiting transcription and/or translation. Alternatively, antisense nucleic acid molecules can be modified to target selected cells and then are administered systemically. For systemic administration, antisense molecules can be modified such that they specifically bind to receptors or antigens expressed on a selected cell surface, for example, by linking antisense nucleic acid molecules to peptides or antibodies which bind to cell surface receptors or antigens. Antisense nucleic acid molecules can also be delivered to cells using vectors. Sufficient intracellular concentrations of antisense molecules are achieved by incorporating a strong promoter, such as a pol II or pol III promoter, in the vector construct.

Antisense nucleic acid molecules sometimes are anomeric nucleic acid molecules (Gautier et al., 1987). Antisense nucleic acid molecules can also comprise a 2'-o-methylribonucleotide (Inoue et al., 1987a) or a chimeric RNA-DNA analogue (Inoue et al., 1987b). Antisense nucleic acids sometimes are composed of DNA or peptide nucleic acid (PNA).

In another embodiment, an antisense nucleic acid is a ribozyme. A ribozyme having specificity for a target nucleotide sequence can include one or more sequences complementary to such a nucleotide sequence, and a sequence having a known catalytic region responsible for mRNA cleavage (see e.g., U.S. Pat. No. 5,093,246 or Haselhoff and Gerlach (Haseloff and Gerlach, 1988). For example, a derivative of a Tetrahymena L-19 IVS RNA is sometimes utilized in which the nucleotide sequence of the active site is complementary to the nucleotide sequence to be cleaved in a mRNA (see e.g., Cech et al., U.S. Pat. No. 4,987,071; and Cech et al., U.S. Pat. No. 5,116,742). Also, target mRNA sequences can be used to select a catalytic RNA having a specific ribonuclease activity from a pool of RNA molecules (Bartel and Szostak, 1993).

Colorectal cancer directed molecules include in certain embodiments nucleic acids that can form triple helix structures with a target nucleotide sequence, especially one that includes a regulatory region that controls expression of a polypeptide. Gene expression can be inhibited by targeting nucleotide sequences complementary to the regulatory region of a target nucleotide sequence (e.g., promoter and/or enhancers) to form triple helical structures that prevent transcription of a gene in target cells (Helene, 1991; Helene et al., 1992; Maher, III, 1992). Potential sequences that can be targeted for triple helix formation can be increased by creating a switchback nucleic acid molecule. Switchback molecules are synthesized in an alternating 5'-3',3'-5' manner, such that they base pair with first one strand of a duplex and then the other, eliminating the necessity for a sizeable stretch of either purines or pyrimidines to be present on one strand of a duplex.

Colorectal cancer directed molecules include RNAi and siRNA nucleic acids. Gene expression may be inhibited by the introduction of double-stranded RNA (dsRNA), which induces potent and specific gene silencing, a phenomenon called RNA interference or RNAi. See, e.g., Fire et al., U.S. Pat. No. 6,506,559; Tuschl et al., PCT International Publication No. WO 01/75164; Kay et al., PCT International Publication No. WO 03/010180A1; or Bosher J M, Labouesse (Bosher and Labouesse, 2000). This process has been improved by decreasing the size of the double-stranded RNA to 20-24 base pairs (to create small-interfering RNAs or siRNAs) that switched off genes in mammalian cells without initiating an acute phase response, i.e., a host defense mechanism that often results in cell death (Caplen et al., 2001a; Elbashir et al., 2002). There is increasing evidence of post-transcriptional gene silencing by RNA interference (RNAi) for inhibiting targeted expression in mammalian cells at the mRNA level, in human cells. There is additional evidence of effective methods for inhibiting the proliferation and migration of tumor cells in human patients, and for inhibiting metastatic cancer development (see, e.g., U.S. patent application No. US2001000993183; Caplen et al. (Caplen et al., 2001b), Abderrahman et al. (Abderrahmani et al., 2001).

An siRNA or RNAi is a nucleic acid that forms a double stranded RNA and has the ability to reduce or inhibit expression of a gene or target gene when the siRNA is delivered to or expressed in the same cell as the gene or target gene. siRNA is short double-stranded RNA formed by the complementary strands. Complementary portions of the siRNA that hybridize to form the double stranded molecule often have substantial or complete identity to the target molecule sequence. In one embodiment, an siRNA is a nucleic acid that has substantial or complete identity to a target gene and forms a double stranded siRNA.

When designing the siRNA molecules, the targeted region often is selected from a given DNA sequence beginning 50 to 100 nucleotides downstream of the start codon. See, e.g., Elbashir et al. (Elbashir et al., 2002). Initially, 5' or 3' UTRs and regions nearby the start codon were avoided assuming that UTR-binding proteins and/or translation initiation complexes may interfere with binding of the siRNP or RISC endonuclease complex. Sometimes regions of the target 23 nucleotides in length conforming to the sequence motif AA (N19)TT (N, an nucleotide), and regions with approximately 30% to 70% G/C-content (often about 50% G/C-content) often are selected. If no suitable sequences are found, the search often is extended using the motif NA (N2 1). The sequence of the sense siRNA sometimes corresponds to (N19) TT or N21 (position 3 to 23 of the 23-nt motif), respectively. In the latter case, the 3' end of the sense siRNA often is converted to TT. The rationale for this sequence conversion is to generate a symmetric duplex with respect to the sequence composition of the sense and antisense 3' overhangs. The antisense siRNA is synthesized as the complement to position 1 to 21 of the 23-nt motif. Because position 1 of the 23-nt motif is not recognized sequence-specifically by the antisense siRNA, the 3'-most nucleotide residue of the antisense siRNA can be chosen deliberately. However, the penultimate nucleotide of the antisense siRNA (complementary to position 2 of the 23-nt motif) often is complementary to the targeted sequence. For simplifying chemical synthesis, TT often is utilized. siRNAs corresponding to the target motif NAR (N17)YNN, where R is purine (A,G) and Y is pyrimidine (C,U), often are selected. Respective 21 nucleotide sense and antisense siRNAs often begin with a purine nucleotide and can also be expressed from pol III expression vectors without a change in targeting site. Expression of RNAs from pol III promoters can be more efficient when the first transcribed nucleotide is a purine.

The sequence of the siRNA can correspond to the full length target gene, or a subsequence thereof. Often, the siRNA is about 15 to about 50 nucleotides in length (e.g., each complementary sequence of the double stranded siRNA is 15 to 50 nucleotides in length, and the double stranded siRNA is about 15 to 50 base pairs in length, sometimes about 20 to 30 nucleotides in length or about 20 to 25 nucleotides in length, e.g., 20, 21, 22, 23, 24, 25, 26, 27, 28, 29, or 30 nucleotides in length. The siRNA sometimes is about 21 nucleotides in length. Methods of using siRNA are known in the art, and specific siRNA molecules may be purchased from a number of companies including Dharmacon Research, Inc.

Antisense, ribozyme, RNAi and siRNA nucleic acids can be altered to form modified nucleic acid molecules. The nucleic acids can be altered at base moieties, sugar moieties or phosphate backbone moieties to improve stability, hybridization, or solubility of the molecule. For example, the deoxyribose phosphate backbone of nucleic acid molecules can be modified to generate peptide nucleic acids (see Hyrup et al., Bioorganic & Medicinal Chemistry 4 (1): 5-23 (1996)). A peptide nucleic acid, or PNA, refers to a nucleic acid mimic such as a DNA mimic, in which the deoxyribose phosphate backbone is replaced by a pseudopeptide backbone and only the four natural nucleobases are retained. The neutral backbone of a PNA can allow for specific hybridization to DNA and RNA under conditions of low ionic strength. Synthesis of PNA oligomers can be performed using standard solid phase peptide synthesis protocols as described, for example, in Hyrup et al. (Hyrup and Nielsen, 1996), and Perry-O'Keefe et al. (Abderrahmani et al., 2001).

PNA nucleic acids can be used in prognostic, diagnostic, and therapeutic applications. For example, PNAs can be used as anti-sense or anti-gene agents for sequence-specific modulation of gene expression by, for example, inducing transcription or translation arrest or inhibiting replication. PNA nucleic acid molecules can also be used in the analysis of SNPs in a gene, (e.g., by PNA-directed PCR clamping); as artificial restriction enzymes when used in combination with other enzymes, (e.g., S1 nucleases (Hyrup and Nielsen, 1996) or as probes or primers for DNA sequencing or hybridization (Hyrup and Nielsen, 1996; Perry-O'Keefe et al., 1996).

In other embodiments, oligonucleotides may include other appended groups such as peptides (e.g., for targeting host cell receptors in vivo), or agents facilitating transport across cell membranes (see e.g., Letsinger et al. (Letsinger et al., 1989); Lemaitre et al. (Lemaitre et al., 1987) and PCT Publication No. WO88/09810) or the blood-brain barrier (see, e.g., PCT Publication No. WO89/10134). In addition, oligonucleotides can be modified with hybridization-triggered cleavage agents (van der Krol et al., 1988) or intercalating agents (Zon, 1988). To this end, the oligonucleotide may be conjugated to another molecule, (e.g., a peptide, hybridization triggered cross-linking agent, transport agent, or hybridization-triggered cleavage agent).

Also included as part of this invention are molecular beacon oligonucleotide primer and probe molecules having one or more regions complementary to a target nucleotide sequence, two complementary regions one having a fluorophore and one a quencher such that the molecular beacon is useful for quantifying the presence of the nucleic acid in a sample. Molecular beacon nucleic acids are described, for example, in Lizardi et al., U.S. Pat. No. 5,854,033; Nazarenko et al., U.S. Pat. No. 5,866,336, and Livak et al., U.S. Pat. No. 5,876,930.

Antibodies

An immunogen typically is used to prepare antibodies by immunizing a suitable subject, (e.g., rabbit, goat, mouse or other mammal). An appropriate immunogenic preparation can contain, for example, recombinantly expressed chemically synthesized polypeptide. The preparation can further include an adjuvant, such as Freund's complete or incomplete adjuvant, or a similar immunostimulatory agent. Amino acid polymorphisms can be detected using antibodies specific for the altered epitope by western analysis after the electrophoresis of denatured proteins. Protein polymorphism can also be detected using fluorescently identified antibodies which bind to specific polymorphic epitopes and detected in whole cells using fluorescence activated cell sorting techniques (FACS). Polymorphic protein sequence may also be determined by NMR spectroscopy or by x-ray diffraction studies. Further, determination of polymorphic sites in proteins may be accomplished by observing differential cleavage by specific or non specific proteases.

An antibody is an immunoglobulin molecule or immunologically active portion thereof, i.e., an antigen-binding portion. Examples of immunologically active portions of immunoglobulin molecules include F(ab) and F(ab')$_2$ fragments which can be generated by treating the antibody with an enzyme such as pepsin. An antibody can be polyclonal, monoclonal, or recombinant (e.g., a chimeric or humanized), fully human, non-human (e.g., murine), or a single chain antibody. An antibody may have effector function and can fix complement, and is sometimes coupled to a toxin or imaging agent.

A full-length polypeptide or antigenic peptide fragment encoded by a target nucleotide sequence can be used as an immunogen or can be used to identify antibodies made with other immunogens, e.g., cells, membrane preparations, and the like. An antigenic peptide often includes at least 8 amino acid residues of the amino acid sequences encoded by a nucleotide sequence of one of SEQ ID NOs:1761 to 1790, and encompasses an epitope. Antigenic peptides sometimes include 10 or more amino acids, 15 or more amino acids, 20 or more amino acids, or 30 or more amino acids. Hydrophilic and hydrophobic fragments of polypeptides sometimes are used as immunogens.

Epitopes encompassed by the antigenic peptide are regions located on the surface of the polypeptide (e.g., hydrophilic regions) as well as regions with high antigenicity. For example, an Emini surface probability analysis of the human polypeptide sequence can be used to indicate the regions that have a particularly high probability of being localized to the surface of the polypeptide and are thus likely to constitute surface residues useful for targeting antibody production. The antibody may bind an epitope on any domain or region on polypeptides for use in the invention.

Also, chimeric, humanized, and completely human antibodies are useful for applications which include repeated administration to subjects. Chimeric and humanized monoclonal antibodies, comprising both human and non-human portions, can be made using standard recombinant DNA techniques. Such chimeric and humanized monoclonal antibodies can be produced by recombinant DNA techniques, for example using methods described in Robinson et al., International Application No. PCT/US86/02269; Akira, et al., European Patent Application 184,187; Taniguchi, M., European Patent Application 171,496; Morrison et al., European Patent Application 173,494; Neuberger et al., PCT International Publication No. WO 86/01533; Cabilly et al., U.S. Pat. No. 4,816,567; Cabilly et al., European Patent Application 125, 023; (Better et al., 1988; Liu et al., 1987a; Liu et al., 1987b; Sun et al., 1987; Nishimura et al., 1987; Wood et al., 1985; Shaw et al., 1988; Morrison, 1985; Verhoeyen et al., 1988; Beidler et al., 1988) and Winter, U.S. Pat. No. 5,225,539.

Completely human antibodies can be particularly desirable for therapeutic treatment of human patients. Such antibodies can be produced using transgenic mice that are incapable of expressing endogenous immunoglobulin heavy and light chains genes, but which can express human heavy and light chain genes. See, for example, Lonberg and Huszar (Lonberg and Huszar, 1995) and U.S. Pat. Nos. 5,625,126; 5,633,425; 5,569,825; 5,661,016; and 5,545,806. In addition, companies such as Abgenix, Inc. (Fremont, Calif.) and Medarex, Inc. (Princeton, N.J.), can be engaged to provide human antibodies directed against a selected antigen. Completely human antibodies that recognize a selected epitope also can be generated using guided selection. In this approach a selected non-human monoclonal antibody (e.g., a murine antibody) is used to guide the selection of a completely human antibody recognizing the same epitope. This technology is described for example by Jespers et al. (Jespers et al., 1994).

An antibody can be a single chain antibody. A single chain antibody (scFV) can be engineered (see, e.g., Colcher et al. (Colcher et al., 1999) and Reiter (Reiter and Pastan, 1996). Single chain antibodies can be dimerized or multimerized to generate multivalent antibodies having specificities for different epitopes of the same target polypeptide.

Antibodies also may be selected or modified so that they exhibit reduced or no ability to bind an Fc receptor. For example, an antibody may be an isotype or subtype, fragment or other mutant, which does not support binding to an Fc receptor (e.g., it has a mutagenized or deleted Fc receptor binding region).

Also, an antibody (or fragment thereof) may be conjugated to a therapeutic moiety such as a cytotoxin, a therapeutic agent or a radioactive metal ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1 dehydrotestosterone, glucocorticoids, procaine, tetracaine, lidocaine, propranolol, and puromycin and analogs or homologs thereof. Therapeutic agents include antimetabolites (e.g., methotrexate, 6-mercaptopurine, 6-thioguanine, cytarabine, 5-fluorouracil decarbazine), alkylating agents (e.g., mechlorethamine, thiotepa chlorambucil, melphalan, carmustine (BCNU) and lomustine (CCNU), cyclophosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

Antibody conjugates can be used for modifying a given biological response. For example, the drug moiety may be a protein or polypeptide possessing a desired biological activity. Such proteins may include, for example, a toxin such as abrin, ricin A, pseudomonas exotoxin, or diphtheria toxin; a polypeptide such as tumor necrosis factor, γ-interferon, α-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors. Also, an antibody can be conjugated to a second antibody to form an antibody heteroconjugate as described by Segal in U.S. Pat. No. 4,676,980, for example.

An antibody (e.g., monoclonal antibody) can be used to isolate target polypeptides by standard techniques, such as affinity chromatography or immunoprecipitation. Moreover, an antibody can be used to detect a target polypeptide (e.g., in a cellular lysate or cell supernatant) in order to evaluate the abundance and pattern of expression of the polypeptide. Antibodies can be used diagnostically to monitor polypeptide levels in tissue as part of a clinical testing procedure, e.g., to determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^3H$. Also, an antibody can be utilized as a test molecule for determining whether it can treat colorectal cancer, and as a therapeutic for administration to a subject for treating colorectal cancer.

An antibody can be made by immunizing with a purified antigen, or a fragment thereof, a membrane associated antigen, tissues, e.g., crude tissue preparations, whole cells, preferably living cells, lysed cells, or cell fractions.

Included as part of this invention are antibodies which bind only a native polypeptide, only denatured or otherwise non-native polypeptide, or which bind both, as well as those having linear or conformational epitopes. Conformational epitopes sometimes can be identified by selecting antibodies that bind to native but not denatured polypeptide. Also featured are antibodies that specifically bind to a polypeptide variant associated with colorectal cancer.

Screening Assays

The invention includes methods for identifying a candidate therapeutic for treating colorectal cancer. The methods include contacting a test molecule with a target molecule in a system. A target molecule is a nucleic acid molecule having a sequence of any of SEQ ID NOs:1 to 1790, or a fragment thereof, or an encoded polypeptide of SEQ ID NOs:1761 to 1790. The method also includes determining the presence or absence of an interaction between the test molecule and the target molecule, where the presence of an interaction between the test molecule and the nucleic acid or polypeptide identifies the test molecule as a candidate colorectal cancer therapeutic. The interaction between the test molecule and the target molecule may be quantified.

Test molecules and candidate therapeutics include compounds, antisense nucleic acids, siRNA molecules, ribozymes, polypeptides or proteins encoded by target nucleic acids, and immunotherapeutics (e.g., antibodies and HLA-presented polypeptide fragments). A test molecule or candidate therapeutic may act as a modulator of target molecule concentration or target molecule function in a system. A modulator may agonize (i.e., up-regulates) or antagonize (i.e., down-regulates) a target molecule concentration partially or completely in a system by affecting such cellular functions as DNA replication and/or DNA processing (e.g., DNA methylation or DNA repair), RNA transcription and/or RNA processing (e.g., removal of intronic sequences and/or translocation of spliced mRNA from the nucleus), polypeptide production (e.g., translation of the polypeptide from mRNA), and/or polypeptide post-translational modification (e.g., glycosylation, phosphorylation, and proteolysis of pro-polypeptides). A modulator may also agonize or antagonize a biological function of a target molecule partially or completely, where the function may include adopting a certain structural conformation, interacting with one or more binding partners, ligand binding, catalysis (e.g., phosphorylation, dephosphorylation, hydrolysis, methylation, and isomerization), and an effect upon a cellular event (e.g., effecting progression of colorectal cancer).

According to an aspect of this invention a system, i.e., a cell free in vitro environment and a cell-based environment such as a collection of cells, a tissue, an organ, or an organism, is contacted with a test molecule in a variety of manners, including adding molecules in solution and allowing them to interact with one another by diffusion, cell injection, and any administration routes in an animal. An interaction refers to an effect of a test molecule on test molecule, where the effect sometimes is binding between the test molecule and the target molecule, and sometimes is an observable change in cells, tissue, or organism.

There are known methods for detecting the presence or absence of interaction between a test molecule and a target molecule. For example, titrametric, acidimetric, radiometric, NMR, monolayer, polarographic, spectrophotometric, fluorescent, and ESR assays probative of a target molecule interaction may be utilized.

Test molecule/target molecule interactions can be detected and/or quantified using known assays. For example, an interaction can be determined by labeling the test molecule and/or the target molecule, where the label is covalently or non-covalently attached to the test molecule or target molecule. The label is sometimes a radioactive molecule such as $^{125}$I, $^{131}$I, $^{35}$S or $^3$H, which can be detected by direct counting of radio-emission or by scintillation counting. Also, enzymatic labels such as horseradish peroxidase, alkaline phosphatase, or luciferase may be utilized where the enzymatic label can be detected by determining conversion of an appropriate substrate to product. In addition, presence or absence of an interaction can be determined without labeling. For example, a microphysiometer (e.g., Cytosensor) is an analytical instrument that measures the rate at which a cell acidifies its environment using a light-addressable potentiometric sensor (LAPS). Changes in this acidification rate can be used as an indication of an interaction between a test molecule and target molecule (McConnell et al., 1992).

In cell-based systems, cells typically include a nucleic acid from SEQ ID NOs:1 to 1790 or an encoded polypeptide from SEQ ID NOs:1761 to 1790, and are often of mammalian origin, although the cell can be of any origin. Whole cells, cell homogenates, and cell fractions (e.g., cell membrane fractions) can be subjected to analysis. Where interactions between a test molecule with a target polypeptide are monitored, soluble and/or membrane bound forms of the polypeptide may be utilized. Where membrane-bound forms of the polypeptide are used, it may be desirable to utilize a solubilizing agent. Examples of such solubilizing agents include non-ionic detergents such as n-octylglucoside, n-dodecylglucoside, n-dodecylmaltoside, octanoyl-N-methylglucamide, decanoyl-N-methylglucamide, TritonTMX-100, Triton™ X-114, etc.

An interaction between a test molecule and target molecule also can be detected by monitoring fluorescence energy transfer (FET) (see, e.g., Lakowicz et al., U.S. Pat. No. 5,631,169; Stavrianopoulos et al., U.S. Pat. No. 4,868,103). A fluorophore label on a first, donor molecule is selected such that its emitted fluorescent energy will be absorbed by a fluorescent label on a second, acceptor molecule, which in turn is able to fluoresce due to the absorbed energy. Alternately, the donor polypeptide molecule may simply utilize the natural fluorescent energy of tryptophan residues. Labels are chosen that emit different wavelengths of light, such that the acceptor molecule label may be differentiated from that of the donor. Since the efficiency of energy transfer between the labels is related to the distance separating the molecules, the spatial relationship between the molecules can be assessed. In a situation in which binding occurs between the molecules, the fluorescent emission of the acceptor molecule label in the assay should be maximal. An FET binding event can be conveniently measured through standard fluorometric detection means well known in the art (e.g., using a fluorimeter).

In another embodiment, determining the presence or absence of an interaction between a test molecule and a target molecule can be effected by monitoring surface plasmon resonance (Sjolander and Urbaniczky, 1991; Szabo et al., 1995). Surface plasmon resonance (SPR) or biomolecular interaction analysis (BIA) can be utilized to detect biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance, resulting in a detectable signal which can be used as an indication of real-time reactions between biological molecules.

In another embodiment, the target molecule or test molecules are anchored to a solid phase, facilitating the detection of target molecule/test molecule complexes and separation of the complexes from free, uncomplexed molecules. The target molecule or test molecule is immobilized to the solid support. In one embodiment, the target molecule is anchored to a solid surface, and the test molecule, which is not anchored, can be labeled, either directly or indirectly, with detectable labels.

It may be desirable to immobilize a target molecule, an anti-target molecule antibody, and/or test molecules to facilitate separation of target molecule/test molecule complexes from uncomplexed forms, as well as to accommodate automation of the assay. The attachment between a test molecule and/or target molecule and the solid support may be covalent or non-covalent (see, e.g., U.S. Pat. No. 6,022,688 for non-covalent attachments). The solid support may be one or more surfaces of the system, such as one or more surfaces in each well of a microtiter plate, a surface of a silicon wafer, a surface of a bead (Lam et al., 1991) that is optionally linked to another solid support, or a channel in a microfluidic device, for example. Types of solid supports, linker molecules for covalent and non-covalent attachments to solid supports, and methods for immobilizing nucleic acids and other molecules to solid supports are known (see, e.g., U.S. Pat. Nos. 6,261,776; 5,900,481; 6,133,436; and 6,022,688; and WIPO publication WO 01/18234).

In one embodiment, a target molecule may be immobilized to surfaces via biotin and streptavidin. For example, a biotinylated polypeptide can be prepared from biotin-NHS (N-hydroxysuccinimide, e.g., biotinylation kit, Pierce Chemicals, Rockford, Ill.), and immobilized in the wells of streptavidin-coated 96 well plates (Pierce Chemical). In another embodiment, a target polypeptide can be prepared as a fusion polypeptide. For example, glutathione-S-transferase/-polypeptide fusion can be adsorbed onto glutathione sepharose beads (Sigma Chemical, St. Louis, Mo.) or glutathione derivatized microtiter plates, which are then combined with a test molecule under conditions conducive to complex formation (e.g., at physiological conditions for salt and pH). Following incubation, the beads or microtiter plate wells are washed to remove any unbound components, or the matrix is immobilized in the case of beads, and complex formation is determined directly or indirectly as described above. Alternatively, the complexes can be dissociated from the matrix, and the level of target molecule binding or activity is determined using standard techniques.

In one embodiment, the non-immobilized component is added to the coated surface containing the anchored component. After the reaction is complete, unreacted components are removed (e.g., by washing) under conditions such that a significant percentage of complexes formed will remain immobilized to the solid surface. The detection of complexes anchored on the solid surface can be accomplished in a number of manners. Where the previously non-immobilized component is pre-labeled, the detection of label immobilized on the surface indicates that complexes were formed. Where the previously non-immobilized component is not pre-labeled, an indirect label can be used to detect complexes anchored on the surface, e.g., by adding a labeled antibody specific for the immobilized component, where the antibody, in turn, can be directly labeled or indirectly labeled with, e.g., a labeled anti-Ig antibody.

In another embodiment, an assay is performed utilizing antibodies that specifically bind a target molecule or test molecule but do not interfere with binding of the target molecule to the test molecule. Such antibodies can be linked to a solid support, and unbound target molecule may be immobilized by antibody conjugation. Methods for detecting such complexes, in addition to those described above for the GST-immobilized complexes, include immunodetection of complexes using antibodies reactive with the target molecule, as well as enzyme-linked assays which rely on detecting an enzymatic activity associated with the target molecule.

Cell free assays also can be conducted in a liquid phase. In such an assay, reaction products are separated from unreacted components, by known techniques, including: differential centrifugation (Rivas and Minton, 1993); electrophoresis (1999) and immunoprecipitation (1999). Media and chromatographic techniques are known (Heegaard, 1998; Hage and Tweed, 1997). Further, fluorescence energy transfer may also be conveniently utilized to detect binding without further purification of the complex from solution.

In another embodiment, modulators of target molecule expression are identified. For example, a cell or cell free mixture is contacted with a candidate compound and the expression of target mRNA or polypeptide is evaluated relative to the level of expression of target mRNA or polypeptide in the absence of the candidate compound. When expression of target mRNA or polypeptide is greater in the presence of the candidate compound than in its absence, the candidate compound is identified as an agonist of target mRNA or polypeptide expression. Alternatively, when expression of target mRNA or polypeptide is less (e.g., less with statistical significance) in the presence of the candidate compound than in its absence, the candidate compound is identified as an antagonist or inhibitor of target mRNA or polypeptide expression. The level of target mRNA or polypeptide expression can be determined by methods described herein.

In another embodiment, binding partners that interact with a target molecule are detected. The target molecules can interact with one or more cellular or extra-cellular macromolecules, such as polypeptides in vivo, and these interacting molecules or binding partners. Binding partners can agonize or antagonize target molecule biological activity. Also, test molecules that agonize or antagonize interactions between target molecules and binding partners can be useful as therapeutic molecules as they can up-regulate or down-regulated target molecule activity in vivo and thereby treat colorectal cancer.

Binding partners of target molecules can be identified by known methods. For example, binding partners may be identified by lysing cells and analyzing cell lysates by electrophoretic techniques. Alternatively, a two-hybrid assay or three-hybrid assay can be utilized (Zervos et al., 1993; Madura et al., 1993; Bartel et al., 1993; Iwabuchi et al., 1993): see also, e.g., U.S. Pat. No. 5,283,317 and Brent WO94/10300. A two-hybrid system is based on the modular nature of most transcription factors, which consist of separable DNA-binding and activation domains. The assay often utilizes two different DNA constructs. In one construct, a nucleic acid from one of SEQ ID NOs:1761 to 1790, sometimes referred to as the bait, is fused to a gene encoding the DNA binding domain of a known transcription factor (e.g., GAL-4). In another construct, a DNA sequence from a library of DNA sequences that encodes a potential binding partner, sometimes referred to as the prey, is fused to a gene that encodes an activation domain of the known transcription factor. Sometimes, a target nucleic acid can be fused to the activation domain. If the bait and the prey molecules interact in vivo, the DNA-binding and activation domains of the transcription factor are brought into close proximity. This proximity allows transcription of a reporter gene (e.g., lacZ) which is operably linked to a transcriptional regulatory site responsive to the transcription factor. Expression of the reporter gene can be detected and cell colonies containing the functional transcription factor can be isolated and used to identify the potential binding partner.

In an embodiment for identifying test molecules that antagonize or agonize complex formation between target molecules and binding partners, a reaction mixture containing the target molecule and the binding partner is prepared, under conditions and for a time sufficient to allow complex formation. The reaction mixture often is provided in the presence or absence of the test molecule. The test molecule can be included initially in the reaction mixture, or can be added at a time subsequent to the addition of the target molecule and its binding partner. Control reaction mixtures are incubated without the test molecule or with a placebo. Formation of any complexes between the target molecule and the binding partner then is detected. Decreased formation of a complex in the reaction mixture containing test molecule as compared to in a control reaction mixture indicates that the molecule antagonizes target molecule/binding partner complex formation. Alternatively, increased formation of a complex in the reaction mixture containing test molecule as compared to in a control reaction mixture, indicates that the molecule agonizes target molecule/binding partner complex formation. In another embodiment, complex formation of target molecule/binding partner can be compared to complex formation of mutant target molecule/binding partner (e.g., amino acid modifications in a target polypeptide). Such a comparison can be important in those cases where it is desirable to identify test molecules that modulate interactions of mutant but not non-mutated target gene products.

The assays can be conducted in a heterogeneous or homogeneous format. In heterogeneous assays, a target molecule and/or the binding partner are immobilized to a solid phase, and complexes are detected on the solid phase at the end of the reaction. In homogeneous assays, the entire reaction is carried out in a liquid phase. In either approach, the order of addition of reactants can be varied to obtain different information about the molecules being tested. For example, test compounds that agonize target molecule/binding partner interactions can be identified by conducting the reaction in the presence of the test molecule in a competition format. Alternatively, test molecules that agonize preformed complexes, e.g., molecules with higher binding constants that displace one of the components from the complex, can be tested by adding the test compound to the reaction mixture after complexes have been formed.

In a heterogeneous assay, the target molecule or the binding partner is anchored onto a solid surface (e.g., a microtiter plate), while the non-anchored species is labeled, either directly or indirectly. The anchored molecule can be immobilized by non-covalent or covalent attachments. Alternatively, an immobilized antibody specific for the molecule to be anchored can be used to anchor the molecule to the solid surface. The partner of the immobilized species is exposed to the coated surface with or without the test molecule. After the reaction is complete, unreacted components are removed (e.g., by washing) such that a significant portion of any complexes formed will remain immobilized on the solid surface. Where the non-immobilized species is pre-labeled, the detection of label immobilized on the surface is indicative of complex. Where the non-immobilized species is not pre-labeled, an indirect label can be used to detect complexes anchored to the surface; e.g., by using a labeled antibody specific for the initially non-immobilized species. Depending upon the order of addition of reaction components, test compounds that inhibit complex formation or that disrupt preformed complexes can be detected.

The reaction can be conducted in a liquid phase in the presence or absence of test molecule, where the reaction products are separated from unreacted components, and the complexes are detected (e.g., using an immobilized antibody specific for one of the binding components to anchor any complexes formed in solution, and a labeled antibody specific for the other partner to detect anchored complexes). Again, depending upon the order of addition of reactants to the liquid phase, test compounds that inhibit complex or that disrupt preformed complexes can be identified.

In an alternate embodiment, a homogeneous assay can be utilized. For example, a preformed complex of the target gene product and the interactive cellular or extra-cellular binding partner-product is prepared. One or both of the target molecule or binding partner is labeled, and the signal generated by the label(s) is quenched upon complex formation (e.g., U.S. Pat. No. 4,109,496 that-utilizes this approach for immunoassays). Addition of a test molecule that competes with and displaces one of the species from the preformed complex will result in the generation of a signal above background. In this way, test substances that disrupt target molecule/binding partner complexes can be identified.

Identification of Candidate Therapeutics

Candidate therapeutics for treating colorectal cancer are identified from a group of test molecules that interact with a target molecule. Test molecules are normally ranked according to the degree with which they modulate (e.g., agonize or antagonize) a function associated with the target molecule (e.g., DNA replication and/or processing, RNA transcription and/or processing, polypeptide production and/or processing, and/or biological function/activity), and then top ranking modulators are selected. Also, pharmacogenomic information can determine the rank of a modulator. The top 10% of ranked test molecules often are selected for further testing as candidate therapeutics, and sometimes the top 15%, 20%, or 25% of ranked test molecules are selected for further testing as candidate therapeutics. Candidate therapeutics typically are formulated for administration to a subject.

Therapeutic Formulations

Formulations and pharmaceutical compositions typically include in combination with a pharmaceutically acceptable carrier one or more target molecule modulators. The modulator often is a test molecule identified as having an interaction with a target molecule by a screening method. The modulator may be a compound, an antisense nucleic acid, a ribozyme, an antibody, or a binding partner. Also, formulations may include a polypeptide combination with a pharmaceutically acceptable carrier.

A pharmaceutically acceptable carrier includes solvents, dispersion media, coatings, antibacterial and antifungal agents, isotonic and absorption delaying agents, and the like, compatible with pharmaceutical administration. See for example, Remington's Pharmaceutical Sciences (2005). Supplementary active compounds can also be incorporated into the compositions. Pharmaceutical compositions can be included in a container, pack, or dispenser together with instructions for administration.

A pharmaceutical composition typically is formulated to be compatible with its intended route of administration. Examples of routes of administration include parenteral, e.g., intravenous, intradermal, subcutaneous, oral (e.g., inhalation), transdermal (topical), transmucosal, and rectal administrations Solutions or suspensions used for parenteral, intradermal, or subcutaneous application can include the following components: a sterile diluent such as water for injection, saline solution, fixed oils, polyethylene glycols, glycerin, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate; a glidant such as colloidal silicon dioxide; a sweetening agent such as sucrose or saccharin; or a flavoring agent such as peppermint, methyl salicylate, or orange flavoring.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). The composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol or sorbitol, and/or sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the methods of preparation often utilized are vacuum drying and freeze-drying which yields a powder of the active ingredient plus any additional desired ingredient from a previously sterile-filtered solution thereof.

Systemic administration might be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art. Molecules can also be prepared in the form of suppositories (e.g., with conventional suppository bases such as cocoa butter and other glycerides) or retention enemas for rectal delivery.

In one embodiment, active molecules are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is advantageous to formulate oral or parenteral compositions in dosage unit form for ease of administration and uniformity of dosage. Each unit containing a predetermined quantity of active compound is calculated to produce the desired therapeutic effect in association with the required pharmaceutical carrier.

Toxicity and therapeutic efficacy of such compounds can be determined by standard pharmaceutical procedures in cell cultures or experimental animals, e.g., for determining the $LD_{50}$ (the dose lethal to 50% of the population) and the ED.sub.50 (the dose therapeutically effective in 50% of the population). The dose ratio between toxic and therapeutic effects is the therapeutic index and it can be expressed as the ratio $LD_{50}/ED_{50}$. Molecules which exhibit high therapeutic indices often are utilized. While molecules that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such molecules typically lies within a range of circulating concentrations that include the $ED_{50}$ with little or no toxicity. The dosage may vary within this range depending upon the dosage form employed and the route of administration utilized. For any molecules used in methods described herein, the therapeutically effective dose can be estimated initially from cell culture assays. A dose may be formulated in animal models to achieve a circulating plasma concentration range that includes the IC.sub.50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of protein or polypeptide (i.e., an effective dosage) ranges from about 0.001 to 30 mg/kg body weight, sometimes about 0.01 to 25 mg/kg body weight, often about 0.1 to 20 mg/kg body weight, and more often about 1 to 10 mg/kg, 2 to 9 mg/kg, 3 to 8 mg/kg, 4 to 7 mg/kg, or 5 to 6 mg/kg body weight. The protein or polypeptide can be administered one time per week for between about 1 to 10 weeks, sometimes between 2 to 8 weeks, often between about 3 to 7 weeks, and more often for about 4, 5, or 6 weeks. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, can include a series of treatments.

For antibodies, a dosage of 0.1 mg/kg of body weight (generally 10 mg/kg to 20 mg/kg) is often utilized. If the antibody is to act in the brain, a dosage of 50 mg/kg to 100 mg/kg is often appropriate. Generally, partially human antibodies and fully human antibodies have a longer half-life within the human body than other antibodies. Accordingly, lower dosage and less frequent administration is often possible. Modifications such as lipidation can be used to stabilize antibodies and to enhance uptake and tissue penetration (e.g., into the brain). A method for lipidation of antibodies is described by Cruikshank et al. (Cruikshank et al., 1997).

Antibody conjugates can be used for modifying a given biological response, the drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a polypeptide such as tumor necrosis factor, alpha-interferon, beta-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other growth factors. Alternatively, an antibody can be conjugated to a second antibody to form an antibody heteroconjugate as described by Segal in U.S. Pat. No. 4,676,980.

For compounds, exemplary doses include milligram or microgram amounts of the compound per kilogram of subject or sample weight, for example, about 1 microgram per kilogram to about 500 milligrams per kilogram, about 100 micrograms per kilogram to about 5 milligrams per kilogram, or about 1 microgram per kilogram to about 50 micrograms per kilogram. It is understood that appropriate doses of a small molecule depend upon the potency of the small molecule with respect to the expression or activity to be modulated. When one or more of these small molecules is to be administered to an animal (e.g., a human) in order to modulate expression or activity of a polypeptide or nucleic acid described herein, a physician, veterinarian, or researcher may, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

With regard to nucleic acid formulations, gene therapy vectors can be delivered to a subject by, for example, intravenous injection, local administration (see, e.g., U.S. Pat. No. 5,328,470) or by stereotactic injection (Chen et al., 1994). Pharmaceutical preparations of gene therapy vectors can include a gene therapy vector in an acceptable diluent, or can comprise a slow release matrix in which the gene delivery vehicle is imbedded. Alternatively, where the complete gene delivery vector can be produced intact from recombinant cells (e.g., retroviral vectors) the pharmaceutical preparation can include one or more cells which produce the gene delivery system. Examples of gene delivery vectors are described herein.

Therapeutic Methods

A therapeutic formulation described above can be administered to a subject in need of a therapeutic for treating colorectal cancer. Therapeutic formulations can be administered by any of the paths described herein. With regard to both prophylactic and therapeutic methods of treatment, such treatments may be specifically tailored or modified, based on knowledge obtained from pharmacogenomic analyses described herein.

A treatment is the application or administration of a therapeutic formulation to a subject, or application or administration of a therapeutic agent to an isolated tissue or cell line from a subject with the purpose to cure, heal, alleviate, relieve, alter, remedy, ameliorate, improve or affect colorectal cancer, symptoms of colorectal cancer or a predisposition towards colorectal cancer. A therapeutic formulation includes small molecules, peptides, antibodies, ribozymes and antisense oligonucleotides. Administration of a therapeutic formulation can occur prior to the manifestation of symptoms characteristic of colorectal cancer, such that the cancer is prevented or delayed in its progression. The appropriate therapeutic composition can be determined based on screening assays described herein.

As discussed, successful treatment of colorectal cancer can be brought about by techniques that serve to agonize target molecule expression or function, or alternatively, antagonize target molecule expression or function. These techniques include administration of modulators that include, but are not limited to, small organic or inorganic molecules; antibodies (including, for example, polyclonal, monoclonal, humanized, anti-idiotypic, chimeric or single chain antibodies, and FAb, F(ab')$_2$ and FAb expression library fragments, scFV molecules, and epitope-binding fragments thereof); and peptides, phosphopeptides, or polypeptides.

Further, antisense and ribozyme molecules that inhibit expression of the target gene can also be used to reduce the level of target gene expression, thus effectively reducing the level of target gene activity. Still further, triple helix molecules can be utilized in reducing the level of target gene activity. Antisense, ribozyme and triple helix molecules are discussed above. It is possible that the use of antisense, ribozyme, and/or triple helix molecules to reduce or inhibit mutant gene expression can also reduce or inhibit the transcription (triple helix) and/or translation (antisense, ribozyme) of mRNA produced by normal target gene alleles, such that the concentration of normal target gene product present can be lower than is necessary for a normal phenotype. In such cases, nucleic acid molecules that encode and express target gene polypeptides exhibiting normal target gene activity can be introduced into cells via gene therapy method. Alternatively, in instances in that the target gene encodes an extra-cellular polypeptide, it can be preferable to co-administer normal target gene polypeptide into the cell or tissue in order to maintain the requisite level of cellular or tissue target gene activity.

Another method by which nucleic acid molecules may be utilized in treating or preventing colorectal cancer is use of aptamer molecules specific for target molecules. Aptamers are nucleic acid molecules having a tertiary structure which permits them to specifically bind to ligands (Osborne et al., 1997; Patel, 1997).

Yet another method of utilizing nucleic acid molecules for colorectal cancer treatment is gene therapy, which can also be referred to as allele therapy. The invention thus includes a gene therapy method for treating colorectal cancer in a subject, which includes contacting one or more cells in the subject or from the subject with a nucleic acid having a first nucleotide sequence. Genomic DNA in the subject includes a second nucleotide sequence having one or more SNPs associated with colorectal cancer. The first and second nucleotide sequences typically are substantially identical to one another, and the first nucleotide sequence comprises fewer SNPs associated with colorectal cancer than the second nucleotide sequence. The first nucleotide sequence may comprise a gene sequence that encodes a full-length polypeptide or a fragment thereof. The subject is often a human. Allele therapy methods often are utilized in conjunction with a method of first determining whether a subject has genomic DNA that includes SNPs associated with colorectal cancer.

Another allele therapy is a method which comprises contacting one or more cells in the subject or from the subject with a polypeptide encoded by a nucleic acid having a first nucleotide sequence. Genomic DNA in the subject includes a second nucleotide sequence having one or more SNPs associated with colorectal cancer. The first and second nucleotide sequences typically are substantially identical to one another, and the first nucleotide sequence includes fewer SNPs associated with colorectal cancer than the second nucleotide sequence. The first nucleotide sequence may include a gene sequence that encodes a full-length polypeptide or a fragment thereof. The subject is usually a human.

For antibody-based therapies, antibodies can be generated that are both specific for target molecules and that reduce target molecule activity. Such antibodies may be administered in instances where antagonizing a target molecule function is appropriate for the treatment of colorectal cancer.

In circumstances where stimulating antibody production in an animal or a human subject by injection with a target molecule is harmful to the subject, it is possible to generate an immune response against the target molecule by use of anti-idiotypic antibodies (Herlyn and Birebent, 1999; Bhattacharya-Chatterjee and Foon, 1998). Introducing an anti-idiotypic antibody to a mammal or human subject often stimulates production of anti-anti-idiotypic antibodies, which typically are specific to the target molecule. Vaccines directed to colorectal cancer also may be generated in this fashion.

In instances where the target molecule is intracellular and whole antibodies are used, internalizing antibodies often are utilized. Lipofectin or liposomes can be used to deliver the antibody or a fragment of the Fab region that binds to the target antigen into cells. Where fragments of the antibody are used, the smallest inhibitory fragment that binds to the target antigen often is utilized. For example, peptides having an amino acid sequence corresponding to the Fv region of the antibody can be used. Alternatively, single chain neutralizing antibodies that bind to intracellular target antigens can also be administered. Such single chain antibodies can be administered, for example, by expressing nucleotide sequences encoding single-chain antibodies within the target cell population (Marasco et al., 1993).

Modulators can be administered to a patient at therapeutically effective doses to treat colorectal cancer. A therapeutically effective dose refers to an amount of the modulator sufficient to result in amelioration of symptoms of colorectal cancer. Toxicity and therapeutic efficacy of modulators can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Modulators that exhibit large therapeutic indices often are utilized. While modulators that exhibit toxic side effects can be used, care should be taken to design a delivery system that targets such molecules to the site of affected tissue in order to minimize potential damage to uninfected cells, thereby reducing side effects.

Data obtained from cell culture assays and animal studies can be used in formulating a range of dosages for use in humans. The dosage of such compounds typically lies within a range of circulating concentrations that include the $ED_{50}$ with little or no toxicity. The dosage can vary within this range depending upon the dosage form employed and the route of administration utilized. The therapeutically effective dose can be estimated initially from cell culture assays. A dose can be formulated in animal models to achieve a circulating plasma concentration range that includes the $IC_{50}$ (i.e., the concentration of the test compound that achieves a half-maximal inhibition of symptoms) as determined in cell culture. Such information can be used to more accurately determine useful doses in humans. Levels in plasma can be measured, for example, by high performance liquid chromatography.

Another example of effective dose determination for an individual is the ability to directly assay levels of "free" and "bound" compound in the serum of the test subject. Such assays may utilize antibody mimics and/or "biosensors" that have been created through molecular imprinting techniques. Molecules that modulate target molecule activity are used as a template, or "imprinting molecule", to spatially organize polymerizable monomers prior to their polymerization with catalytic reagents. The subsequent removal of the imprinted molecule leaves a polymer matrix which contains a repeated "negative image" of the compound and is able to selectively rebind the molecule under biological assay conditions. A detailed review of this technique can be seen in Ansell et al. (Ansell et al., 1996). Such "imprinted" affinity matrixes are amenable to ligand-binding assays, whereby the immobilized monoclonal antibody component is replaced by an appropriately imprinted matrix. An example of the use of such matrixes in this way can be seen in Vlatakis, et al. (Vlatakis et al., 1993). Through the use of isotope-labeling, the "free" concentration of compound which modulates target molecule expression or activity readily can be monitored and used in calculations of $IC_{50}$. Such "imprinted" affinity matrixes can also be designed to include fluorescent groups whose photon-emitting properties measurably change upon local and selective binding of target compound. These changes readily can be assayed in real time using appropriate fiberoptic devices, in turn allowing the dose in a test subject to be quickly optimized based on its individual $IC_{50}$.

The examples set forth below are intended to illustrate but not limit the invention.

Genomic DNA samples from patients aged 25-74 and patients with both familial and sporadic CRC with family and unrelated ethnically matched controls were studied. We identified CRC-associated alleles by measuring 99,632 single nucleotide polymorphisms in peripheral blood DNA from 2,475 subjects (1,234 cases with colorectal cancer and 1,241 age matched individuals undiseased at the time of testing), and validating the identified CRC-associated alleles by using peripheral blood DNA from a second, different, group of 2,194 subjects (1,139 cases with colorectal cancer and 1,055 age matched individuals undiseased at the time of testing). Patients with clinically documented well characterized inherited colorectal cancer syndromes such as Familial Adenomatous Polyposis (FAP) or Hereditary Non Polyposis Colorectal Cancer were excluded from our analysis. Single nucleotide polymorphisms were selected to maximize measurement of genomic variability by choosing these markers that were in the greatest degree of linkage disequilibrium with neighboring SNPs. This was determined by calculating correlation coefficients ($r^2$) with successive neighboring SNPs at each site of polymorphism until an arbitrary cut off of 0.8 was observed. Marker SNPs selected for measurement were in linkage disequilibrium with a maximal number of adjacent SNPs, thus providing an economical method for measuring diversity over a large portion of the genome.

Single Nucleotide Polymorphisms selected for study were derived from the International Haplotype Mapping Project (http://www.hapmap.org) August 2004 release, information about which is available from the National Institutes of Health, National Institutes of Health (NIH; http://www.nih.gov/), 9000 Rockville Pike, Bethesda, Md. 20892. The SNPs were analyzed on DNA from our control and study population using either the Illumina Bead Array system (http://www.illumina.com; Illumina, Inc., 9885 Towne Centre Drive, San Diego, Calif. 92121-1975), the MIP platform (http://www.affymetrix.com, Affymetrix, Inc., 3380 Central Expressway, Santa Clara, Calif. 95051), the Affymetrix GeneChip® Human Mapping 100K Set platform (http://www.affymetrix.com, Affymetrix, Inc., 3380 Central Expressway, Santa Clara, Calif. 95051), or the Affymetrix GeneChip® Human Mapping 500K Array Set platform (http://www.affymetrix.com, Affymetrix, Inc., 3380 Central Expressway, Santa Clara, Calif. 95051). The SNPs for the Illumina Bead Array system were selected on the basis of being associated with genes involved in DNA repair, chromosomal stability or signal transduction and expressed in human colon epithelium. The SNPs for the MIP platform were selected to include most SNPs that would alter the coding sequence of a protein product. The SNPs for the Affymetrix GeneChip® Human Mapping 100K Set platform were selected as to cover the entire genome, but the SNPs were preferentially selected in genic regions present on XbaI or HindIII restriction fragments varying in length from about 250 base pairs to about 2000 base pairs. The SNPs for the Affymetrix GeneChip® Human Mapping 500K Array Set platforms were selected as to cover the entire genome, but the SNPs were preferentially selected in genic regions present on NspI and StyI restriction fragments varying in length from about 200 base pairs to about 1100 base pairs. Data was stored and organized using the Nanuq informatics environment of the McGill University and Genome Quebec Innovation Centre (http://www.genomequebec.mcgill.ca/; McGill University and Genome Quebec Innovation Centre, 740, Docteur Penfield Avenue, Montreal, Quebec H3A 1A4). Allele frequencies found within DNA from patients with colorectal cancer and those without this disease were compared using the univariate Mantel-Haenszel Chi-Square statistic.

The inventors of the present invention have discovered single base pair polymorphisms that are present in a highly significant percentage of the genetic DNA of individuals affected with colorectal cancer while only present in a smaller percentage of individuals who are not known to be affected by the disease.

EXAMPLE 1

For individuals with colorectal cancer, the distribution of polymorphic alleles at position 20900501 of chromosome 1, found within the EIF4G3 gene, was different from those without colorectal cancer (Table 1). The recessive test for risk associated with carrying the C allele had an empirical p-value of 0.008235 based on permutation analysis, and the corresponding recessive odds ratio is 1.353 (Table 1). These data further suggest that this marker, located within the EIF4G3 gene, is associated with colorectal cancer risk and that the C allele at position 20900501 of chromosome 1 is associated with an increased risk of developing colorectal cancer.

TABLE 1

| | |
|---|---|
| rs no. | 2320590 |
| Chromosome; Position | 1; 20900501 |
| Gene Name | EIF4G3 |
| SEQ ID NO; Position | 1761; 222293 |
| Genotype; Phenotype | n = C; increased risk |
| Hardy-Weinberg | 0.07125 |

TABLE 1-continued

| Case Flag | Allele B | AA | AB | BB | Model | p-Value | Odds Ratio |
|---|---|---|---|---|---|---|---|
| 0 | C | 307 | 520 | 173 | Recessive | 0.008235 | 1.353 |
| 1 | C | 295 | 486 | 221 | | | |

Table 1A indicates SNPs found to be in strong linkage disequilibrium with rs2320590. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 1A

Linked SNPs

| SNP | $r^2$ | Position on chr1 | SEQ ID NO |
|---|---|---|---|
| rs951805 | 0.627 | 20805662 | 1 |
| rs710311 | 0.702 | 20807307 | 2 |
| rs12123092 | 0.697 | 20812307 | 3 |
| rs12121807 | 0.702 | 20814435 | 4 |
| rs10916859 | 0.702 | 20833262 | 5 |
| rs7548269 | 0.627 | 20834778 | 6 |
| rs7548649 | 0.702 | 20835387 | 7 |
| rs3736880 | 0.702 | 20843033 | 8 |
| rs651085 | 0.871 | 20843089 | 9 |
| rs651538 | 0.902 | 20843172 | 10 |
| rs589755 | 0.896 | 20845152 | 11 |
| rs1021077 | 0.702 | 20851322 | 12 |
| rs12123093 | 0.603 | 20859722 | 13 |
| rs3856173 | 0.676 | 20860139 | 14 |
| rs4233274 | 0.966 | 20866984 | 15 |
| rs1152999 | 0.57 | 20868329 | 16 |
| rs1152998 | 0.752 | 20869596 | 17 |
| rs3125161 | 0.729 | 20871652 | 18 |
| rs3121071 | 0.551 | 20873726 | 19 |
| rs7520481 | 0.724 | 20885691 | 20 |
| rs935918 | 0.649 | 20890966 | 21 |
| rs10753507 | 0.867 | 20897686 | 22 |
| rs4654873 | 0.603 | 20897690 | 23 |
| rs10799665 | 0.676 | 20897946 | 24 |
| rs2320590 | — | 20900501 | 25 |
| rs4654874 | 0.933 | 20901973 | 26 |
| rs11805169 | 0.697 | 20902168 | 27 |
| rs4654875 | 0.555 | 20910482 | 28 |
| rs935917 | 0.729 | 20912408 | 29 |
| rs4654724 | 0.651 | 20922516 | 30 |
| rs2305463 | 0.868 | 20925487 | 31 |
| rs7543140 | 0.605 | 20925556 | 32 |
| rs1530946 | 0.651 | 20927846 | 33 |
| rs4654880 | 0.745 | 20931914 | 34 |
| rs10916885 | 0.925 | 20934009 | 35 |
| rs6695218 | 0.539 | 20935818 | 36 |
| rs7519685 | 0.651 | 20937929 | 37 |
| rs2167811 | 0.646 | 20939816 | 38 |
| rs3890762 | 0.899 | 20943571 | 39 |
| rs10737452 | 0.651 | 20945070 | 40 |
| rs10916891 | 0.551 | 20945280 | 41 |
| rs4654725 | 0.651 | 20945717 | 42 |
| rs4654726 | 0.729 | 20949204 | 43 |
| rs17449966 | 0.629 | 20949302 | 44 |
| rs7545133 | 0.729 | 20951449 | 45 |
| rs4654881 | 0.934 | 20955075 | 46 |
| rs2290381 | 0.651 | 20958577 | 47 |
| rs4654883 | 0.895 | 20959014 | 48 |
| rs4654727 | 0.729 | 20960041 | 49 |
| rs2275468 | 0.729 | 20965681 | 50 |
| rs6704421 | 0.902 | 20965980 | 51 |
| rs17410008 | 0.651 | 20966007 | 52 |
| rs4654729 | 0.934 | 20969559 | 53 |
| rs3767247 | 0.651 | 20972644 | 54 |
| rs4654887 | 0.729 | 20980229 | 55 |
| rs10916900 | 0.934 | 20984365 | 56 |

TABLE 1A-continued

Linked SNPs

| SNP | $r^2$ | Position on chr1 | SEQ ID NO |
|---|---|---|---|
| rs6699704 | 0.551 | 20986738 | 57 |
| rs10916903 | 0.651 | 20993250 | 58 |
| rs11805006 | 0.934 | 20994909 | 59 |
| rs6692677 | 0.934 | 20997023 | 60 |
| rs17450586 | 0.565 | 20999899 | 61 |
| rs12407731 | 0.934 | 21000095 | 62 |
| rs10916906 | 0.643 | 21000981 | 63 |
| rs6698440 | 0.9 | 21004018 | 64 |
| rs10916907 | 0.9 | 21006394 | 65 |
| rs10442633 | 0.9 | 21010403 | 66 |
| rs12133780 | 0.694 | 21016114 | 67 |
| rs3767248 | 0.694 | 21022160 | 68 |
| rs6700459 | 0.617 | 21024702 | 69 |
| rs12137408 | 0.9 | 21028251 | 70 |
| rs6697555 | 0.694 | 21033244 | 71 |
| rs10916911 | 0.9 | 21035367 | 72 |
| rs6669077 | 0.894 | 21035826 | 73 |
| rs6697284 | 0.9 | 21040905 | 74 |
| rs2271115 | 0.694 | 21041170 | 75 |
| rs6700718 | 0.687 | 21044669 | 76 |
| rs4654893 | 0.551 | 21050902 | 77 |
| rs12021529 | 0.551 | 21051467 | 78 |
| rs7540023 | 0.571 | 21055398 | 79 |
| rs10916919 | 0.566 | 21062830 | 80 |
| rs10799677 | 0.517 | 21063762 | 81 |
| rs10799678 | 0.9 | 21068091 | 82 |
| rs12123300 | 0.575 | 21068874 | 83 |
| rs2874367 | 0.9 | 21069797 | 84 |
| rs11302414 | 0.664 | 21072609 | 85 |
| rs12130664 | 0.617 | 21078118 | 86 |
| rs6661116 | 0.694 | 21082461 | 87 |
| rs12070677 | 0.898 | 21082628 | 88 |
| rs6681064 | 0.694 | 21084950 | 89 |
| rs6659152 | 0.662 | 21101147 | 90 |
| rs6426658 | 0.617 | 21106482 | 91 |
| rs6685914 | 0.545 | 21107684 | 92 |
| rs6684976 | 0.694 | 21112807 | 93 |
| rs6668370 | 0.9 | 21114874 | 94 |
| rs6703227 | 0.694 | 21120116 | 95 |
| rs964466 | 0.565 | 21120469 | 96 |
| rs10493006 | 0.617 | 21121210 | 97 |
| rs6426665 | 0.9 | 21127511 | 98 |
| rs10916927 | 0.617 | 21131101 | 99 |
| rs6658526 | 0.541 | 21136620 | 100 |
| rs1354792 | 0.9 | 21137181 | 101 |
| rs12567861 | 0.551 | 21140439 | 102 |
| rs10916930 | 0.559 | 21140663 | 103 |
| rs6426667 | 0.897 | 21141522 | 104 |
| rs6426668 | 0.694 | 21141902 | 105 |
| rs6692244 | 0.694 | 21142192 | 106 |
| rs7521711 | 0.9 | 21145524 | 107 |
| rs1567128 | 0.512 | 21149959 | 108 |

EXAMPLE 2

For individuals with colorectal cancer, the distribution of polymorphic alleles at position 54538208 of chromosome 1, found within the SSBP3 gene, was different from those without colorectal cancer (Table 2). The dominant test for risk associated with carrying the C allele had an empirical p-value based on permutation analysis of 0.002647, and the corresponding dominant odds ratio is 1.348 (Table 2). These data further suggest that this marker, located within the SSBP3 gene, is associated with colorectal cancer risk and that the C allele at position 54538208 of chromosome 1 is associated with an increased risk of developing colorectal cancer.

TABLE 2

| rs no. | 10489565 |
|---|---|
| Chromosome; Position | 1; 54538208 |
| Gene Name | SSBP3 |
| SEQ ID NO; Position | 1762; 45710 |
| Genotype; Phenotype | n = C; increased risk |
| Hardy-Weinberg | 0.89558 |

| Case Flag | Allele B | AA | AB | BB | Model | p-Value | Odds Ratio |
|---|---|---|---|---|---|---|---|
| 0 | C | 740 | 240 | 20 | Dominant | 0.002647 | 1.348 |
| 1 | C | 680 | 295 | 27 | | | |

Table 2A indicates SNPs found to be in strong linkage disequilibrium with rs10489565. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 2A

Linked SNPs

| SNP | $r^2$ | Position on chr1 | SEQ ID NO |
|---|---|---|---|
| rs4601533 | 0.929 | 54531998 | 109 |
| rs10489565 | — | 54538208 | 110 |
| rs12024740 | 0.586 | 54548927 | 111 |
| rs2073108 | 0.656 | 54551090 | 112 |
| rs17101278 | 0.656 | 54552517 | 113 |
| rs12029610 | 0.639 | 54556623 | 114 |
| rs3795357 | 0.656 | 54557621 | 115 |
| rs12022116 | 0.635 | 54561302 | 116 |
| rs12043222 | 0.656 | 54561394 | 117 |
| rs2297573 | 0.656 | 54562638 | 118 |
| rs4141420 | 0.591 | 54563585 | 119 |
| rs12045400 | 0.656 | 54563831 | 120 |

EXAMPLE 3

For individuals with colorectal cancer, the distribution of polymorphic alleles at position 97159204 of chromosome 1 was different from those without colorectal cancer (Table 3). The dominant test for risk associated with carrying the C allele had an empirical p-value based on permutation analysis of 0.004716, and the corresponding dominant odds ratio is 1.428 (Table 3). These data further suggest that this marker is associated with colorectal cancer risk and that the C allele at position 97159204 of chromosome 1 is associated with an increased risk of developing colorectal cancer.

TABLE 3

| rs no. | 10493889 |
|---|---|
| Chromosome; Position | 1; 97159204 |
| Gene Name | |
| SEQ ID NO; Position | ; |
| Genotype; Phenotype | n = C; increased risk |
| Hardy-Weinberg | 0.80154 |

| Case Flag | Allele B | AA | AB | BB | Model | p-Value | Odds Ratio |
|---|---|---|---|---|---|---|---|
| 0 | C | 841 | 124 | 5 | Dominant | 0.004716 | 1.428 |
| 1 | C | 817 | 173 | 6 | | | |

Table 3A indicates SNPs found to be in strong linkage disequilibrium with rs10493889. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 3A

Linked SNPs

| SNP | $r^2$ | Position on chr1 | SEQ ID NO |
|---|---|---|---|
| rs17525524 | 0.667 | 96911594 | 121 |
| rs2391782 | 0.667 | 96938696 | 122 |
| rs17115733 | 0.647 | 96961817 | 123 |
| rs12024594 | 0.73 | 97005044 | 124 |
| rs11165746 | 1.0 | 97141267 | 125 |
| rs10493889 | — | 97159204 | 126 |

EXAMPLE 4

For individuals with colorectal cancer, the distribution of polymorphic alleles at position 97657313 of chromosome 1, found within the DPYD gene, was different from those without colorectal cancer (Table 4). The dominant test for risk associated with carrying the A allele had an empirical p-value based on permutation analysis of 0.047614, and the corresponding dominant odds ratio is 1.236 (Table 4). These data further suggest that this marker, located within the DPYD gene, is associated with colorectal cancer risk and that the A allele at position 97657313 of chromosome 1 is associated with an increased risk of developing colorectal cancer.

TABLE 4

| rs no. | 945881 |
|---|---|
| Chromosome; Position | 1; 97657313 |
| Gene Name | DPYD |
| SEQ ID NO; Position | 1763; 441288 |
| Genotype; Phenotype | n = A; increased risk |
| Hardy-Weinberg | 0.17718 |

| Case Flag | Allele B | AA | AB | BB | Model | p-Value | Odds Ratio |
|---|---|---|---|---|---|---|---|
| 0 | A | 236 | 569 | 403 | Dominant | 0.047614 | 1.236 |
| 1 | A | 202 | 609 | 419 | | | |

Table 4A indicates SNPs found to be in strong linkage disequilibrium with rs945881. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 4A

Linked SNPs

| SNP | $r^2$ | Position on chr1 | SEQ ID NO |
|---|---|---|---|
| rs11165879 | 0.699 | 97653506 | 127 |
| rs945881 | — | 97657313 | 128 |
| rs11165881 | 1.0 | 97659904 | 129 |

EXAMPLE 5

For individuals with colorectal cancer, the distribution of polymorphic alleles at position 107056364 of chromosome 1 was different from those without colorectal cancer (Table 5). The trend test for risk associated with carrying the A allele had an empirical p-value of 0.0856 based on permutation analysis, and the corresponding Mantel-Haenszel odds ratio for trend is 1.171 (Table 5). These data further suggest that this marker is associated with colorectal cancer risk and that the A allele at position 107056364 of chromosome 1 is associated with an increased risk of developing colorectal cancer.

TABLE 5

| rs no. | 2049064 |
|---|---|
| Chromosome; Position | 1; 107056364 |
| Gene Name | |
| SEQ ID NO; Position | ; |
| Genotype; Phenotype | n = A; increased risk |
| Hardy-Weinberg | 0.77232 |

| Case Flag | Allele B | AA | AB | BB | Model | p-Value | Odds Ratio |
|---|---|---|---|---|---|---|---|
| 0 | A | 761 | 222 | 14 | Trend | 0.0856 | 1.171 |
| 1 | A | 729 | 247 | 20 | | | |

Table 5A indicates SNPs found to be in strong linkage disequilibrium with rs2049064. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 5A

Linked SNPs

| SNP | $r^2$ | Position on chr1 | SEQ ID NO |
|---|---|---|---|
| rs11184922 | 0.502 | 106818235 | 130 |
| rs7530540 | 0.61 | 106828844 | 131 |
| rs4914979 | 0.61 | 106830088 | 132 |
| rs4409683 | 0.631 | 106833215 | 133 |
| rs10430081 | 0.568 | 106891798 | 134 |
| rs7527883 | 0.688 | 106912949 | 135 |
| rs12066688 | 0.688 | 106928115 | 136 |
| rs7545951 | 0.574 | 106930964 | 137 |
| rs4311915 | 0.688 | 106937218 | 138 |
| rs17017475 | 0.688 | 106971827 | 139 |
| rs17017532 | 0.935 | 106998017 | 140 |
| rs17017567 | 0.932 | 107004258 | 141 |
| rs12085613 | 0.932 | 107006719 | 142 |
| rs12078403 | 0.935 | 107010986 | 143 |
| rs12409858 | 0.935 | 107011275 | 144 |
| rs11184981 | 0.873 | 107011305 | 145 |
| rs12407314 | 0.935 | 107011409 | 146 |
| rs12406199 | 0.932 | 107011554 | 147 |
| rs12407335 | 0.935 | 107011627 | 148 |
| rs12410591 | 0.932 | 107012941 | 149 |
| rs10494050 | 0.935 | 107014445 | 150 |
| rs12079669 | 0.928 | 107017707 | 151 |
| rs10494052 | 0.935 | 107021830 | 152 |
| rs17017658 | 0.935 | 107024684 | 153 |
| rs17492154 | 0.63 | 107025142 | 154 |
| rs2139462 | 0.935 | 107033827 | 155 |
| rs17017694 | 0.932 | 107034845 | 156 |
| rs17017723 | 1.0 | 107044596 | 157 |
| rs17017736 | 1.0 | 107047341 | 158 |
| rs12097821 | 1.0 | 107048343 | 159 |
| rs955988 | 1.0 | 107052637 | 160 |
| rs1519889 | 1.0 | 107054139 | 161 |
| rs1519887 | 1.0 | 107056341 | 162 |
| rs2049064 | — | 107056364 | 163 |
| rs1607634 | 0.734 | 107079348 | 164 |
| rs1519874 | 0.688 | 107080550 | 165 |
| rs2030341 | 0.688 | 107081508 | 166 |
| rs908953 | 0.734 | 107086826 | 167 |
| rs10881449 | 0.688 | 107088101 | 168 |

TABLE 5A-continued

Linked SNPs

| SNP | $r^2$ | Position on chr1 | SEQ ID NO |
|---|---|---|---|
| rs1607635 | 0.63 | 107091984 | 169 |
| rs1156426 | 0.688 | 107092704 | 170 |
| rs7530116 | 0.688 | 107093768 | 171 |
| rs12094371 | 0.688 | 107095587 | 172 |
| rs1519875 | 0.688 | 107096669 | 173 |
| rs1519876 | 0.672 | 107098220 | 174 |
| rs10881450 | 0.688 | 107100885 | 175 |
| rs2102909 | 0.688 | 107103052 | 176 |
| rs7511900 | 0.688 | 107112872 | 177 |
| rs10465780 | 0.672 | 107115313 | 178 |
| rs11184996 | 0.688 | 107115334 | 179 |

EXAMPLE 6

For individuals with colorectal cancer, the distribution of polymorphic alleles at position 114975727 of chromosome 1, found within the D1S155E gene, was different from those without colorectal cancer (Table 6). The dominant test for risk associated with carrying the G allele had an empirical p-value based on permutation analysis of 0.002032, and the corresponding dominant odds ratio is 1.638 (Table 6). These data further suggest that this marker, located within the D1S155E gene, is associated with colorectal cancer risk and that the G allele at position 114975727 of chromosome 1 is associated with an increased risk of developing colorectal cancer.

TABLE 6

| rs no. | 10489525 |
|---|---|
| Chromosome; Position | 1; 114975727 |
| Gene Name | D1S155E |
| SEQ ID NO; Position | 1764; 36894 |
| Genotype; Phenotype | n = G; increased risk |
| Hardy-Weinberg | 0.04271 |

| Case Flag | Allele B | AA | AB | BB | Model | p-Value | Odds Ratio |
|---|---|---|---|---|---|---|---|
| 0 | G | 107 | 388 | 476 | Dominant | 0.002032 | 1.638 |
| 1 | G | 70 | 394 | 532 | | | |

Table 6A indicates SNPs found to be in strong linkage disequilibrium with rs10489525. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 6A

Linked SNPs

| SNP | $r^2$ | Position on chr1 | SEQ ID NO |
|---|---|---|---|
| rs10489525 | — | 114975727 | 183 |

EXAMPLE 7

For individuals with colorectal cancer, the distribution of polymorphic alleles at position 115166656 of chromosome 1, found within the SYCP1 gene, was different from those without colorectal cancer (Table 7). The trend test for risk associated with carrying the A allele had an empirical p-value of 0.002586 based on permutation analysis, and the corresponding Mantel-Haenszel odds ratio for trend is 1.187 (Table 7). These data further suggest that this marker, located within the SYCP1 gene, is associated with colorectal cancer risk and that the A allele at position 115166656 of chromosome 1 is associated with an increased risk of developing colorectal cancer.

TABLE 7

| rs no. | 360659 |
|---|---|
| Chromosome; Position | 1; 115166656 |
| Gene Name | SYCP1 |
| SEQ ID NO; Position | 1765; 57160 |
| Genotype; Phenotype | n = A; increased risk |
| Hardy-Weinberg | 0.43217 |

| Case Flag | Allele B | AA | AB | BB | Model | p-Value | Odds Ratio |
|---|---|---|---|---|---|---|---|
| 0 | A | 414 | 552 | 202 | Trend | 0.002586 | 1.187 |
| 1 | A | 378 | 575 | 264 | | | |

Table 7A indicates SNPs found to be in strong linkage disequilibrium with rs360659. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 7A

Linked SNPs

| SNP | $r^2$ | Position on chr1 | SEQ ID NO |
|---|---|---|---|
| rs2010899 | 0.518 | 114947052 | 180 |
| rs969273 | 0.522 | 114968711 | 181 |
| rs6671984 | 0.522 | 114969563 | 182 |
| rs2007231 | 0.522 | 114978348 | 184 |
| rs2144428 | 0.569 | 114981253 | 185 |
| rs6663115 | 0.522 | 114984296 | 186 |
| rs4140445 | 0.522 | 115004020 | 187 |
| rs3121503 | 0.966 | 115071842 | 188 |
| rs1286555 | 0.542 | 115073938 | 189 |
| rs3121506 | 0.599 | 115075249 | 190 |
| rs3121507 | 0.964 | 115077252 | 191 |
| rs6689326 | 0.583 | 115081154 | 192 |
| rs3126216 | 0.966 | 115084567 | 193 |
| rs1286560 | 0.583 | 115087972 | 194 |
| rs869990 | 0.583 | 115091656 | 195 |
| rs360599 | 0.815 | 115100040 | 196 |
| rs360603 | 0.966 | 115101751 | 197 |
| rs360606 | 0.583 | 115103811 | 198 |
| rs360607 | 0.599 | 115104443 | 199 |
| rs360614 | 1.0 | 115111982 | 200 |
| rs360617 | 0.603 | 115116141 | 201 |
| rs360622 | 1.0 | 115119103 | 202 |
| rs360627 | 1.0 | 115125087 | 203 |
| rs360630 | 0.564 | 115127174 | 204 |
| rs360634 | 1.0 | 115132157 | 205 |
| rs360635 | 0.564 | 115132560 | 206 |
| rs360636 | 1.0 | 115132947 | 207 |
| rs360643 | 1.0 | 115139005 | 208 |
| rs360645 | 0.564 | 115139260 | 209 |
| rs360647 | 1.0 | 115141772 | 210 |
| rs360655 | 0.564 | 115159909 | 211 |
| rs360659 | — | 115166656 | 212 |
| rs360661 | 0.62 | 115167322 | 213 |
| rs360576 | 0.546 | 115171216 | 214 |
| rs360586 | 0.564 | 115179531 | 215 |
| rs360588 | 1.0 | 115180386 | 216 |
| rs360590 | 0.504 | 115182953 | 217 |
| rs360591 | 0.809 | 115183282 | 218 |
| rs360596 | 0.815 | 115185601 | 219 |

TABLE 7A-continued

Linked SNPs

| SNP | $r^2$ | Position on chr1 | SEQ ID NO |
|---|---|---|---|
| rs360668 | 0.815 | 115193640 | 220 |
| rs506934 | 0.51 | 115200356 | 221 |
| rs360675 | 0.583 | 115202960 | 222 |
| rs360682 | 0.815 | 115209101 | 223 |
| rs12135023 | 0.815 | 115217819 | 224 |
| rs1591899 | 0.805 | 115226640 | 225 |
| rs12125190 | 0.815 | 115234779 | 226 |
| rs12026343 | 0.815 | 115236258 | 227 |
| rs7416955 | 0.812 | 115242333 | 228 |
| rs4839017 | 0.815 | 115242502 | 229 |
| rs11102859 | 0.806 | 115242740 | 230 |
| rs6698174 | 0.815 | 115244057 | 231 |
| rs7536888 | 0.815 | 115261728 | 232 |
| rs4839399 | 0.815 | 115268188 | 233 |
| rs11102872 | 0.815 | 115277042 | 234 |
| rs7515454 | 0.815 | 115278233 | 235 |
| rs7517739 | 0.815 | 115278345 | 236 |
| rs7541251 | 0.815 | 115278448 | 237 |
| rs6537849 | 0.815 | 115278686 | 238 |
| rs1575070 | 0.674 | 115279927 | 239 |
| rs1575069 | 0.689 | 115280070 | 240 |
| rs12136420 | 0.689 | 115281663 | 241 |
| rs7530810 | 0.689 | 115282510 | 242 |
| rs7523360 | 0.689 | 115282884 | 243 |
| rs1321108 | 0.689 | 115284407 | 244 |
| rs11102874 | 0.749 | 115285912 | 245 |
| rs3754363 | 0.686 | 115287160 | 246 |
| rs1321107 | 0.583 | 115287345 | 247 |
| rs7514765 | 0.612 | 115289952 | 248 |
| rs1998008 | 0.703 | 115292582 | 249 |
| rs4611011 | 0.633 | 115298443 | 250 |
| rs7413646 | 0.638 | 115298798 | 251 |
| rs11102878 | 0.55 | 115303040 | 252 |

EXAMPLE 8

For individuals with colorectal cancer, the distribution of polymorphic alleles at position 143040559 of chromosome 1, found within the FLJ25124 gene, was different from those without colorectal cancer (Table 8). The recessive test for risk associated with carrying the G allele had an empirical p-value of 0.000396 based on permutation analysis, and the corresponding recessive odds ratio is 1.653 (Table 8). These data further suggest that this marker, located within the FLJ25124 gene, is associated with colorectal cancer risk and that the G allele at position 143040559 of chromosome 1 is associated with an increased risk of developing colorectal cancer.

TABLE 8

| rs no. | 10494240 |
|---|---|
| Chromosome; Position | 1; 143040559 |
| Gene Name | FLJ25124 |
| SEQ ID NO; Position | 1766; 2272 |
| Genotype; Phenotype | n = G; increased risk |
| Hardy-Weinberg | 0.10646 |

| Case Flag | Allele B | AA | AB | BB | Model | p-Value | Odds Ratio |
|---|---|---|---|---|---|---|---|
| 0 | G | 433 | 447 | 90 | Recessive | 0.000396 | 1.653 |
| 1 | G | 433 | 419 | 144 | | | |

Table 8A indicates SNPs found to be in strong linkage disequilibrium with rs10494240. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 8A

Linked SNPs

| SNP | $r^2$ | Position on chr1 | SEQ ID NO |
|---|---|---|---|
| rs4636400 | 0.611 | 142933600 | 253 |
| rs6688400 | 0.71 | 142994415 | 254 |
| rs872786 | 0.71 | 142996870 | 255 |
| rs2274617 | 0.898 | 143024965 | 256 |
| rs12410298 | 0.501 | 143037007 | 257 |
| rs720899 | 1.0 | 143039966 | 258 |
| rs10494240 | — | 143040559 | 259 |
| rs12125340 | 0.965 | 143043494 | 260 |

EXAMPLE 9

For individuals with colorectal cancer, the distribution of polymorphic alleles at position 20254115 of chromosome 2 was different from those without colorectal cancer (Table 9). The dominant test for risk associated with carrying the C allele had an empirical p-value based on permutation analysis of 0.028471, and the corresponding dominant odds ratio is 1.265 (Table 9). These data further suggest that this marker is associated with colorectal cancer risk and that the C allele at position 20254115 of chromosome 2 is associated with an increased risk of developing colorectal cancer.

TABLE 9

| rs no. | 973128 |
|---|---|
| Chromosome; Position | 2; 20254115 |
| Gene Name | |
| SEQ ID NO; Position | ; |
| Genotype; Phenotype | n = C; increased risk |
| Hardy-Weinberg | 0.56307 |

| Case Flag | Allele B | AA | AB | BB | Model | p-Value | Odds Ratio |
|---|---|---|---|---|---|---|---|
| 0 | C | 249 | 475 | 245 | Dominant | 0.028471 | 1.265 |
| 1 | C | 213 | 513 | 266 | | | |

Table 9A indicates SNPs found to be in strong linkage disequilibrium with rs973128. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 9A

Linked SNPs

| SNP | $r^2$ | Position on chr2 | SEQ ID NO |
|---|---|---|---|
| rs17697743 | 0.755 | 20250764 | 261 |
| rs6753830 | 1.0 | 20250981 | 262 |
| rs975951 | 1.0 | 20252966 | 263 |
| rs973128 | — | 20254115 | 264 |
| rs875411 | 1.0 | 20254650 | 265 |
| rs875412 | 1.0 | 20255588 | 266 |
| rs6744463 | 1.0 | 20256013 | 267 |
| rs2881879 | 0.534 | 20257476 | 268 |
| rs4666362 | 0.522 | 20258973 | 269 |

TABLE 9A-continued

Linked SNPs

| SNP | $r^2$ | Position on chr2 | SEQ ID NO |
|---|---|---|---|
| rs6531212 | 0.522 | 20259648 | 270 |
| rs46663641 | 0.513 | 20260227 | 271 |

EXAMPLE 10

For individuals with colorectal cancer, the distribution of polymorphic alleles at position 49189474 of chromosome 2, found within the FSHR gene, was different from those without colorectal cancer (Table 10). The trend test for risk associated with carrying the G allele had an empirical p-value of 0.005443 based on permutation analysis, and the corresponding Mantel-Haenszel odds ratio for trend is 1.193 (Table 10). These data further suggest that this marker, located within the FSHR gene, is associated with colorectal cancer risk and that the G allele at position 49189474 of chromosome 2 is associated with an increased risk of developing colorectal cancer.

TABLE 10

| | |
|---|---|
| rs no. | 1504175 |
| Chromosome; Position | 2; 49189474 |
| Gene Name | FSHR |
| SEQ ID NO; Position | 1767; 103808 |
| Genotype; Phenotype | n = G; increased risk |
| Hard-Weinberg | 0.43804 |

| Case Flag | Allele B | AA | AB | BB | Model | p-Value | Odds Ratio |
|---|---|---|---|---|---|---|---|
| 0 | G | 323 | 501 | 175 | Trend | 0.005443 | 1.193 |
| 1 | G | 281 | 498 | 220 | | | |

Table 10A indicates SNPs found to be in strong linkage disequilibrium with rs1504175. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 10A

Linked SNPs

| SNP | $r^2$ | Position on chr2 | SEQ ID NO |
|---|---|---|---|
| rs3788981 | 0.506 | 49157212 | 272 |
| rs9807991 | 0.693 | 49163446 | 273 |
| rs10171892 | 0.579 | 49169518 | 274 |
| rs10865238 | 0.626 | 49180455 | 275 |
| rs12614817 | 0.776 | 49183068 | 276 |
| rs3850344 | 0.731 | 49184463 | 277 |
| rs6716567 | 1.0 | 49185265 | 278 |
| rs11125197 | 1.0 | 49186995 | 279 |
| rs13004879 | 0.688 | 49187513 | 280 |
| rs3913665 | 0.757 | 49187893 | 281 |
| rs1504175 | — | 49189474 | 282 |
| rs1504177 | 0.737 | 49189694 | 283 |
| rs2134811 | 0.757 | 49190619 | 284 |
| rs13032266 | 1.0 | 49191171 | 285 |
| rs1504188 | 0.74 | 49191484 | 286 |
| rs1504190 | 0.737 | 49192006 | 287 |
| rs2091786 | 0.565 | 49195881 | 288 |
| rs1394207 | 0.572 | 49199434 | 289 |
| rs4420736 | 0.565 | 49199611 | 290 |

TABLE 10A-continued

Linked SNPs

| SNP | $r^2$ | Position on chr2 | SEQ ID NO |
|---|---|---|---|
| rs11686474 | 0.565 | 49199634 | 291 |
| rs11680730 | 0.565 | 49199711 | 292 |
| rs11676909 | 0.581 | 49203878 | 293 |
| rs12473815 | 0.579 | 49204013 | 294 |
| rs11125206 | 0.598 | 49204336 | 295 |
| rs1882560 | 0.565 | 49205020 | 296 |
| rs12620805 | 0.598 | 49205539 | 297 |
| rs11903014 | 0.786 | 49205989 | 298 |
| rs6716923 | 0.552 | 49227109 | 299 |
| rs976230 | 0.552 | 49239677 | 300 |
| rs11898430 | 0.539 | 49239769 | 301 |
| rs974896 | 0.568 | 49242500 | 302 |
| rs974897 | 0.552 | 49242583 | 303 |
| rs4510264 | 0.552 | 49244528 | 304 |
| rs9309159 | 0.502 | 49253703 | 305 |
| rs1032838 | 0.556 | 49311997 | 306 |
| rs11125217 | 0.556 | 49319087 | 307 |
| rs11685850 | 0.556 | 49329514 | 308 |
| rs9309160 | 0.556 | 49329682 | 309 |
| rs6720857 | 0.506 | 49332061 | 310 |
| rs4564810 | 0.53 | 49332761 | 311 |
| rs11125222 | 0.524 | 49335916 | 312 |

EXAMPLE 11

For individuals with colorectal cancer, the distribution of polymorphic alleles at position 186869364 of chromosome 2 was different from those without colorectal cancer (Table 11). The recessive test for risk associated with carrying the G allele had an empirical p-value of 0.002126 based on permutation analysis, and the corresponding recessive odds ratio is 3.892 (Table 11). These data further suggest that this marker is associated with colorectal cancer risk and that the G allele at position 186869364 of chromosome 2 is associated with an increased risk of developing colorectal cancer.

TABLE 11

| | |
|---|---|
| rs no. | 10497667 |
| Chromosome; Position | 2; 186869364 |
| Gene Name | |
| SEQ ID NO; Position | ; |
| Genotype; Phenotype | n = G; increased risk |
| Hardy-Weinberg | 0.12585 |

| Case Flag | Allele B | AA | AB | BB | Model | p-Value | Odds Ratio |
|---|---|---|---|---|---|---|---|
| 0 | G | 797 | 197 | 6 | Recessive | 0.002126 | 3.892 |
| 1 | G | 791 | 188 | 23 | | | |

Table 11A indicates SNPs found to be in strong linkage disequilibrium with rs10497667. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 11A

Linked SNPs

| SNP | $r^2$ | Position on chr2 | SEQ ID NO |
|---|---|---|---|
| rs7582258 | 0.611 | 186729521 | 313 |
| rs12615770 | 0.611 | 186748482 | 314 |
| rs12998383 | 0.635 | 186752544 | 315 |
| rs16827480 | 0.63 | 186753368 | 316 |
| rs12614513 | 0.726 | 186759677 | 317 |
| rs10931222 | 0.63 | 186771130 | 318 |
| rs991084 | 0.63 | 186774634 | 319 |
| rs13005466 | 0.63 | 186783677 | 320 |
| rs6750636 | 0.61 | 186788675 | 321 |
| rs13003934 | 0.612 | 186795981 | 322 |
| rs12999989 | 0.629 | 186797056 | 323 |
| rs13028175 | 0.59 | 186797101 | 324 |
| rs12999474 | 0.627 | 186804008 | 325 |
| rs12373738 | 0.63 | 186822924 | 326 |
| rs10186498 | 0.63 | 186841731 | 327 |
| rs6725283 | 0.891 | 186849447 | 328 |
| rs13419562 | 0.63 | 186854278 | 329 |
| rs13394207 | 0.63 | 186854406 | 330 |
| rs13421172 | 0.63 | 186856196 | 331 |
| rs4284795 | 1.0 | 186866149 | 332 |
| rs2887816 | 0.63 | 186869233 | 333 |
| rs10497667 | — | 186869364 | 334 |
| rs13388196 | 0.629 | 186870116 | 335 |
| rs2370681 | 0.63 | 186873391 | 336 |
| rs12233005 | 0.63 | 186873805 | 337 |
| rs8179713 | 1.0 | 186874321 | 338 |
| rs13416578 | 0.63 | 186876760 | 339 |
| rs12614595 | 1.0 | 186877596 | 340 |
| rs2370677 | 1.0 | 186878043 | 341 |
| rs4500906 | 0.908 | 186883056 | 342 |
| rs16827554 | 1.0 | 186887466 | 343 |
| rs2370672 | 1.0 | 186891840 | 344 |
| rs2370671 | 1.0 | 186892009 | 345 |
| rs7584724 | 1.0 | 186895423 | 346 |
| rs4461230 | 1.0 | 186897281 | 347 |
| rs16827602 | 1.0 | 186898014 | 348 |
| rs6434164 | 1.0 | 186899824 | 349 |
| rs2370670 | 1.0 | 186903194 | 350 |
| rs16827614 | 1.0 | 186905158 | 351 |
| rs3107174 | 0.915 | 186910195 | 352 |
| rs3107423 | 0.908 | 186918596 | 353 |
| rs2887818 | 0.915 | 186918660 | 354 |
| rs3112312 | 0.901 | 186933341 | 355 |
| rs1878754 | 0.915 | 186935034 | 356 |
| rs3112315 | 0.915 | 186937617 | 357 |
| rs2370659 | 0.915 | 186938372 | 358 |
| rs3112316 | 0.915 | 186938761 | 359 |
| rs3107410 | 0.915 | 186940537 | 360 |
| rs3112317 | 0.915 | 186942136 | 361 |
| rs10195099 | 0.591 | 186944471 | 362 |
| rs2370662 | 0.915 | 186945120 | 363 |
| rs10931232 | 0.915 | 186950816 | 364 |
| rs2029085 | 0.915 | 187032899 | 365 |
| rs10497669 | 0.643 | 187050892 | 366 |

EXAMPLE 12

For individuals with colorectal cancer, the distribution of polymorphic alleles at position 218776751 of chromosome 2, found within the FLJ46536 gene, was different from those without colorectal cancer (Table 12). The recessive test for risk associated with carrying the C allele had an empirical p-value of 0.005832 based on permutation analysis, and the corresponding recessive odds ratio is 1.335 (Table 12). These data further suggest that this marker, located within the FLJ46536 gene, is associated with colorectal cancer risk and that the C allele at position 218776751 of chromosome 2 is associated with an increased risk of developing colorectal cancer.

TABLE 12

| rs no. | 4133195 |
|---|---|
| Chromosome; Position | 2; 218776751 |
| Gene Name | FLJ46536 |
| SEQ ID NO; Position | 1768; 51535 |
| Genotype; Phenotype | n = C; increased risk |
| Hardy-Weinberg | 0.79932 |

| Case Flag | Allele B | AA | AB | BB | Model | p-Value | Ratio |
|---|---|---|---|---|---|---|---|
| 0 | C | 288 | 493 | 219 | Recessive | 0.005832 | 1.335 |
| 1 | C | 279 | 450 | 273 | | | |

Table 12A indicates SNPs found to be in strong linkage disequilibrium with rs4133195. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 12A

Linked SNPs

| SNP | $r^2$ | Position on chr2 | SEQ ID NO |
|---|---|---|---|
| rs4672870 | 0.647 | 218767422 | 367 |
| rs12694425 | 0.647 | 218767819 | 368 |
| rs12694426 | 0.637 | 218767857 | 369 |
| rs10932745 | 0.669 | 218768482 | 370 |
| rs11687200 | 0.665 | 218770121 | 371 |
| rs11676275 | 0.669 | 218770314 | 372 |
| rs12694427 | 0.669 | 218770551 | 373 |
| rs6737563 | 0.934 | 218771180 | 374 |
| rs13013361 | 0.933 | 218773021 | 375 |
| rs4133195 | — | 218776751 | 376 |
| rs6726126 | 1.0 | 218777739 | 377 |
| rs10804264 | 0.819 | 218781315 | 378 |
| rs12694428 | 0.63 | 218784326 | 379 |
| rs13035513 | 0.935 | 218786186 | 380 |
| rs13007992 | 0.792 | 218789557 | 381 |
| rs7426289 | 0.935 | 218791821 | 382 |
| rs6436029 | 0.785 | 218803037 | 383 |
| rs4674257 | 0.935 | 218814280 | 384 |
| rs4674259 | 0.935 | 218816511 | 385 |
| rs6723449 | 0.934 | 218823086 | 386 |
| rs1126579 | 0.967 | 218826240 | 387 |
| rs4674261 | 0.625 | 218830515 | 388 |
| rs11677534 | 0.935 | 218832566 | 389 |
| rs13009946 | 0.935 | 218833258 | 390 |
| rs7594532 | 0.918 | 218833506 | 391 |
| rs7607437 | 0.935 | 218833898 | 392 |
| rs11676348 | 0.74 | 218835652 | 393 |
| rs13027120 | 0.935 | 218846420 | 394 |
| rs1008563 | 0.625 | 218852394 | 395 |
| rs1008562 | 0.935 | 218852478 | 396 |
| rs4674267 | 0.625 | 218871943 | 397 |
| rs13397673 | 0.641 | 218873288 | 398 |

EXAMPLE 13

For individuals with colorectal cancer, the distribution of polymorphic alleles at position 230825727 of chromosome 2 was different from those without colorectal cancer (Table 13). The trend test for risk associated with carrying the C allele had an empirical p-value of 0.022599 based on permutation analysis, and the corresponding Mantel-Haenszel odds ratio for trend is 1.160 (Table 13). These data further suggest that this marker is associated with colorectal cancer risk and that the C allele at position 230825727 of chromosome 2 is associated with an increased risk of developing colorectal cancer.

TABLE 13

| rs no. | 10498243 |
|---|---|
| Chromosome; Position | 2; 230825727 |
| Gene Name | |
| SEQ ID NO; Position | ; |
| Genotype; Phenotype | n = C; increased risk |
| Hardy-Weinberg | 0.12363 |

| Case Flag | Allele B | AA | AB | BB | Model | p-Value | Odds Ratio |
|---|---|---|---|---|---|---|---|
| 0 | C | 467 | 424 | 75 | Trend | 0.022599 | 1.160 |
| 1 | C | 444 | 443 | 107 | | | |

Table 13A indicates SNPs found to be in strong linkage disequilibrium with rs10498243. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 13A

Linked SNPs

| SNP | $r^2$ | Position on chr2 | SEQ ID NO |
|---|---|---|---|
| rs12694839 | 0.527 | 230822818 | 399 |
| rs12694840 | 0.523 | 230822908 | 400 |
| rs6706782 | 1.0 | 230823742 | 401 |
| rs6707129 | 1.0 | 230824051 | 402 |
| rs10933323 | 1.0 | 230824308 | 403 |
| rs10933324 | 1.0 | 230824428 | 404 |
| rs1529377 | 1.0 | 230825316 | 405 |
| rs12694841 | 1.0 | 230825613 | 406 |
| rs10498243 | — | 230825727 | 407 |
| rs6715536 | 1.0 | 230825877 | 408 |
| rs1549567 | 1.0 | 230827852 | 409 |
| rs6721137 | 1.0 | 230828862 | 410 |
| rs1365775 | 1.0 | 230829298 | 411 |
| rs10933326 | 1.0 | 230830081 | 412 |
| rs2396713 | 0.961 | 230830316 | 413 |
| rs13004807 | 1.0 | 230830886 | 414 |
| rs10048686 | 1.0 | 230832540 | 415 |
| rs2894694 | 0.501 | 230838320 | 416 |
| rs11677105 | 0.527 | 230842525 | 417 |

EXAMPLE 14

For individuals with colorectal cancer, the distribution of polymorphic alleles at position 25062781 of chromosome 3 was different from those without colorectal cancer (Table 14). The recessive test for risk associated with carrying the A allele had an empirical p-value of 0.009697 based on permutation analysis, and the corresponding recessive odds ratio is 1.298 (Table 14). These data further suggest that this marker is associated with colorectal cancer risk and that the A allele at position 25062781 of chromosome 3 is associated with an increased risk of developing colorectal cancer.

TABLE 14

| rs no. | 4484159 |
|---|---|
| Chromosome; Position | 3; 25062781 |
| Gene Name | |
| SEQ ID NO; Position | ; |
| Genotype; Phenotype | n = A; increased risk |
| Hardy-Weinberg | 0.29815 |

TABLE 14-continued

| Case Flag | Allele B | AA | AB | BB | Model | p-Value | Odds Ratio |
|---|---|---|---|---|---|---|---|
| 0 | A | 22 | 278 | 667 | Recessive | 0.009697 | 1.298 |
| 1 | A | 22 | 231 | 730 | | | |

Table 14A indicates SNPs found to be in strong linkage disequilibrium with rs4484159. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 14A

Linked SNPs

| SNP | $r^2$ | Position on chr3 | SEQ ID NO |
|---|---|---|---|
| rs13067187 | 0.583 | 25052936 | 418 |
| rs6777624 | 0.854 | 25054402 | 419 |
| rs9866836 | 0.877 | 25056885 | 420 |
| rs17015670 | 1.0 | 25061156 | 421 |
| rs4484159 | — | 25062781 | 422 |
| rs1604007 | 0.817 | 25068060 | 423 |
| rs988268 | 0.808 | 25076452 | 424 |
| rs6550943 | 0.778 | 25084253 | 425 |
| rs6777955 | 0.932 | 25084806 | 426 |
| rs6766372 | 0.757 | 25086476 | 427 |
| rs994267 | 0.825 | 25090198 | 428 |
| rs1574901 | 0.825 | 25090417 | 429 |
| rs6775433 | 0.824 | 25091862 | 430 |
| rs4858698 | 0.825 | 25093457 | 431 |
| rs7430038 | 0.825 | 25099388 | 432 |
| rs1587430 | 0.825 | 25100369 | 433 |
| rs4858700 | 0.517 | 25102693 | 434 |
| rs11294076 | 0.788 | 25105990 | 435 |
| rs4858703 | 0.825 | 25108277 | 436 |
| rs2036270 | 0.825 | 25112900 | 437 |
| rs972016 | 0.825 | 25114656 | 438 |
| rs1603987 | 0.825 | 25115540 | 439 |
| rs6807196 | 0.696 | 25117575 | 440 |
| rs4858704 | 0.517 | 25118394 | 441 |
| rs1580817 | 0.825 | 25121605 | 442 |

EXAMPLE 15

For individuals with colorectal cancer, the distribution of polymorphic alleles at position 25244762 of chromosome 3, found within the LOC442077 gene, was different from those without colorectal cancer (Table 15). The trend test for risk associated with carrying the A allele had an empirical p-value of 0.005641 based on permutation analysis, and the corresponding Mantel-Haenszel odds ratio for trend is 1.300 (Table 15). These data further suggest that this marker, located within the LOC442077 gene, is associated with colorectal cancer risk and that the A allele at position 25244762 of chromosome 3 is associated with an increased risk of developing colorectal cancer.

TABLE 15

| rs no. | 10510558 |
|---|---|
| Chromosome; Position | 3; 25244762 |
| Gene Name | LOC442077 |
| SEQ ID NO; Position | 1769; 53870 |
| Genotype; Phenotype | n = A; increased risk |
| Hardy-Weinberg | 0.80066 |

TABLE 15-continued

| Case Flag | Allele B | AA | AB | BB | Model | p-Value | Odds Ratio |
|---|---|---|---|---|---|---|---|
| 0 | A | 20 | 253 | 724 | Trend | 0.005641 | 1.300 |
| 1 | A | 13 | 209 | 779 | | | |

Table 15A indicates SNPs found to be in strong linkage disequilibrium with rs10510558. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 15A

Linked SNPs

| SNP | $r^2$ | Position on chr3 | SEQ ID NO |
|---|---|---|---|
| rs13060347 | 0.929 | 25169305 | 443 |
| rs17517792 | 0.929 | 25170688 | 444 |
| rs17517931 | 0.914 | 25184366 | 445 |
| rs13068891 | 0.853 | 25188663 | 446 |
| rs13061437 | 0.924 | 25194200 | 447 |
| rs17578042 | 0.929 | 25205423 | 448 |
| rs17578259 | 0.929 | 25207827 | 449 |
| rs13100362 | 0.872 | 25211158 | 450 |
| rs2068130 | 0.818 | 25211837 | 451 |
| rs1561115 | 0.932 | 25235457 | 452 |
| rs17015971 | 0.932 | 25238040 | 453 |
| rs13096074 | 0.844 | 25239011 | 454 |
| rs17015978 | 1.0 | 25239845 | 455 |
| rs7432016 | 1.0 | 25243914 | 456 |
| rs10510558 | — | 25244762 | 457 |
| rs10510559 | 1.0 | 25244932 | 458 |
| rs10510560 | 1.0 | 25245547 | 459 |
| rs13092896 | 0.799 | 25250478 | 460 |
| rs7427426 | 1.0 | 25264520 | 461 |
| rs1601161 | 1.0 | 25265009 | 462 |
| rs1992060 | 0.919 | 25269521 | 463 |
| rs1992059 | 0.932 | 25273091 | 464 |
| rs13082318 | 0.932 | 25273425 | 465 |
| rs13087573 | 0.932 | 25274083 | 466 |
| rs17016060 | 0.932 | 25275052 | 467 |
| rs13074533 | 0.932 | 25277488 | 468 |
| rs10510561 | 0.932 | 25279386 | 469 |
| rs17016078 | 0.932 | 25280012 | 470 |
| rs13093059 | 0.932 | 25280571 | 471 |
| rs13068143 | 0.932 | 25283486 | 472 |
| rs13091754 | 0.932 | 25283965 | 473 |
| rs17016117 | 0.932 | 25284812 | 474 |
| rs17016120 | 0.932 | 25285067 | 475 |
| rs13059799 | 0.932 | 25287098 | 476 |
| rs13082440 | 0.928 | 25287161 | 477 |
| rs17016133 | 0.932 | 25288171 | 478 |
| rs13084418 | 0.932 | 25291318 | 479 |
| rs13084608 | 0.932 | 25291410 | 480 |
| rs17016141 | 0.861 | 25295964 | 481 |
| rs1436239 | 0.861 | 25300483 | 482 |

EXAMPLE 16

For individuals with colorectal cancer, the distribution of polymorphic alleles at position 62952892 of chromosome 3 was different from those without colorectal cancer (Table 16). The recessive test for risk associated with carrying the C allele had an empirical p-value of 0.001158 based on permutation analysis, and the corresponding recessive odds ratio is 2.127 (Table 16). These data further suggest that this marker is associated with colorectal cancer risk and that the C allele at position 62952892 of chromosome 3 is associated with an increased risk of developing colorectal cancer.

TABLE 16

| rs no. | 4404442 |
|---|---|
| Chromosome; Position | 3; 62952892 |
| Gene Name | |
| SEQ ID NO; Position | ; |
| Genotype; Phenotype | n = C; increased risk |
| Hardy-Weinberg | 0.06369 |

| Case Flag | Allele B | AA | AB | BB | Model | p-Value | Odds Ratio |
|---|---|---|---|---|---|---|---|
| 0 | C | 623 | 321 | 27 | Recessive | 0.001158 | 2.127 |
| 1 | C | 627 | 310 | 57 | | | |

Table 16A indicates SNPs found to be in strong linkage disequilibrium with rs4404442. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 16A

Linked SNPs

| SNP | $r^2$ | Position on chr3 | SEQ ID NO |
|---|---|---|---|
| rs9828340 | 0.528 | 62937809 | 483 |
| rs12631618 | 1.0 | 62941462 | 484 |
| rs6807315 | 1.0 | 62943033 | 485 |
| rs4312654 | 1.0 | 62943151 | 486 |
| rs4583651 | 1.0 | 62943547 | 487 |
| rs13072243 | 1.0 | 62945427 | 488 |
| rs4613448 | 0.948 | 62949979 | 489 |
| rs4404442 | — | 62952892 | 490 |
| rs13091015 | 1.0 | 62955440 | 491 |
| rs9814898 | 1.0 | 62957942 | 492 |
| rs17067503 | 1.0 | 62958060 | 493 |
| rs10510890 | 0.948 | 62959133 | 494 |
| rs9821058 | 1.0 | 62959399 | 495 |
| rs10510891 | 1.0 | 62960430 | 496 |
| rs13084396 | 1.0 | 62961266 | 497 |
| rs4147406 | 0.95 | 62962215 | 498 |
| rs2367590 | 1.0 | 62964393 | 499 |
| rs17067527 | 0.898 | 62965607 | 500 |
| rs12488885 | 0.948 | 62966446 | 501 |
| rs17361212 | 0.752 | 62966549 | 502 |
| rs11130909 | 0.947 | 62968123 | 503 |
| rs13099709 | 0.948 | 62968779 | 504 |
| rs13079904 | 0.948 | 62968976 | 505 |
| rs2367591 | 0.898 | 62969677 | 506 |
| rs9850740 | 0.947 | 62970029 | 507 |
| rs10510892 | 0.948 | 62970190 | 508 |
| rs2367592 | 0.852 | 62970589 | 509 |
| rs11130910 | 0.887 | 62971291 | 510 |
| rs7372226 | 0.947 | 62972138 | 511 |
| rs13061838 | 0.898 | 62975188 | 512 |
| rs6770985 | 0.528 | 62981633 | 513 |
| rs1447443 | 0.528 | 62982901 | 514 |
| rs12637433 | 0.528 | 62983787 | 515 |
| rs4688357 | 0.555 | 62985367 | 516 |

EXAMPLE 17

For individuals with colorectal cancer, the distribution of polymorphic alleles at position 120037273 of chromosome 3 was different from those without colorectal cancer (Table 17). The trend test for risk associated with carrying the A allele had an empirical p-value of 0.000464 based on permutation analysis, and the corresponding Mantel-Haenszel odds ratio for trend is 1.407 (Table 17). These data further suggest that this marker is associated with colorectal cancer risk and that the A allele at position 120037273 of chromosome 3 is associated with an increased risk of developing colorectal cancer.

TABLE 17

| rs no. | 1402582 |
|---|---|
| Chromosome; Position | 3; 120037273 |
| Gene Name | |
| SEQ ID NO; Position | ; |
| Genotype; Phenotype | n = A; increased risk |
| Hardy-Weinberg | 0.00386 |

| Case Flag | Allele B | AA | AB | BB | Model | p-Value | Odds Ratio |
|---|---|---|---|---|---|---|---|
| 0 | A | 776 | 202 | 3 | Trend | 0.000464 | 1.407 |
| 1 | A | 710 | 254 | 11 | | | |

Table 17A indicates SNPs found to be in strong linkage disequilibrium with rs1402582. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 17A

Linked SNPs

| SNP | $r^2$ | Position on chr3 | SEQ ID NO |
|---|---|---|---|
| rs1081903 | 0.549 | 120036240 | 519 |
| rs1402582 | — | 120037273 | 520 |
| rs812824 | 0.608 | 120037336 | 521 |
| rs2936727 | 0.608 | 120037804 | 522 |
| rs1521289 | 0.608 | 120039183 | 523 |
| rs2684320 | 0.608 | 120039851 | 524 |
| rs2649882 | 0.608 | 120044441 | 525 |

EXAMPLE 18

For individuals with colorectal cancer, the distribution of polymorphic alleles at position 120037336 of chromosome 3 was different from those without colorectal cancer (Table 18). The recessive test for risk associated with carrying the G allele had an empirical p-value of 0.001767 based on permutation analysis, and the corresponding recessive odds ratio is 1.986 (Table 18). These data further suggest that this marker is associated with colorectal cancer risk and that the G allele at position 120037336 of chromosome 3 is associated with an increased risk of developing colorectal cancer.

TABLE 18

| rs no. | 812824 |
|---|---|
| Chromosome; Position | 3; 120037336 |
| Gene Name | |
| SEQ ID NO; Position | ; |
| Genotype; Phenotype | n = G; increased risk |
| Hardy-Weinberg | 0.01053 |

| Case Flag | Allele B | AA | AB | BB | Model | p-Value | Odds Ratio |
|---|---|---|---|---|---|---|---|
| 0 | G | 582 | 357 | 32 | Recessive | 0.001767 | 1.986 |
| 1 | G | 575 | 356 | 63 | | | |

Table 18A indicates SNPs found to be in strong linkage disequilibrium with rs812824. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 18A

Linked SNPs

| SNP | $r^2$ | Position on chr3 | SEQ ID NO |
|---|---|---|---|
| rs881603 | 0.705 | 120013362 | 517 |
| rs881604 | 0.711 | 120013382 | 518 |
| rs1081903 | 0.953 | 120036240 | 519 |
| rs1402582 | 0.608 | 120037273 | 520 |
| rs812824 | — | 120037336 | 521 |
| rs2936727 | 1.0 | 120037804 | 522 |
| rs1521289 | 1.0 | 120039183 | 523 |
| rs2684320 | 1.0 | 120039851 | 524 |
| rs2649882 | 1.0 | 120044441 | 525 |

EXAMPLE 19

For individuals with colorectal cancer, the distribution of polymorphic alleles at position 186033203 of chromosome 3, found within the KIAA0804 gene, was different from those without colorectal cancer (Table 19). The trend test for risk associated with carrying the A allele had an empirical p-value of 0.009969 based on permutation analysis, and the corresponding Mantel-Haenszel odds ratio for trend is 1.193 (Table 19). These data further suggest that this marker, located within the KIAA0804 gene, is associated with colorectal cancer risk and that the A allele at position 186033203 of chromosome 3 is associated with an increased risk of developing colorectal cancer.

TABLE 19

| rs no. | 9830734 |
|---|---|
| Chromosome; Position | 3; 186033203 |
| Gene Name | KIAA0804 |
| SEQ ID NO; Position | 1770; 8081 |
| Genotype; Phenotype | n = A; increased risk |
| Hardy-Weinberg | 0.08380 |

| Case Flag | Allele B | AA | AB | BB | Model | p-Value | Odds Ratio |
|---|---|---|---|---|---|---|---|
| 0 | A | 98 | 512 | 520 | Trend | 0.009969 | 1.193 |
| 1 | A | 81 | 472 | 583 | | | |

Table 19A indicates SNPs found to be in strong linkage disequilibrium with rs9830734. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 19A

Linked SNPs

| SNP | $r^2$ | Position on chr3 | SEQ ID NO |
|---|---|---|---|
| rs4686769 | 0.765 | 186008653 | 526 |
| rs2377115 | 0.71 | 186008673 | 527 |
| rs725656 | 0.636 | 186008910 | 528 |
| rs7640976 | 1.0 | 186012692 | 529 |
| rs13079793 | 0.619 | 186027445 | 530 |
| rs10513799 | 0.636 | 186032241 | 531 |
| rs9830734 | — | 186033203 | 532 |

TABLE 19A-continued

Linked SNPs

| SNP | $r^2$ | Position on chr3 | SEQ ID NO |
|---|---|---|---|
| rs4432622 | 0.617 | 186038166 | 533 |
| rs11710551 | 0.643 | 186041770 | 534 |
| rs16859344 | 0.636 | 186043671 | 535 |
| rs2305240 | 0.636 | 186049741 | 536 |
| rs11720538 | 0.623 | 186052729 | 537 |
| rs6443999 | 0.6 | 186056257 | 538 |
| rs16859357 | 0.593 | 186058136 | 539 |
| rs724273 | 0.597 | 186058533 | 540 |
| rs6809079 | 0.597 | 186059022 | 541 |
| rs7340698 | 0.636 | 186060619 | 542 |
| rs3733165 | 0.553 | 186063619 | 543 |
| rs2377107 | 0.593 | 186070576 | 544 |
| rs7619460 | 0.597 | 186070838 | 545 |
| rs9757458 | 0.615 | 186072802 | 546 |
| rs7628188 | 0.553 | 186073295 | 547 |
| rs7638317 | 0.557 | 186076934 | 548 |
| rs11717139 | 0.593 | 186079782 | 549 |
| rs11714752 | 0.588 | 186081364 | 550 |
| rs9881074 | 0.593 | 186083378 | 551 |
| rs1000270 | 0.593 | 186090182 | 552 |
| rs6762984 | 0.529 | 186099834 | 553 |
| rs4324453 | 0.593 | 186104572 | 554 |
| rs7618180 | 0.557 | 186112996 | 555 |
| rs9821657 | 0.557 | 186113805 | 556 |
| rs4686879 | 0.556 | 186115949 | 557 |
| rs7611263 | 0.597 | 186117351 | 558 |
| rs9825856 | 0.604 | 186119962 | 559 |
| rs9290804 | 0.557 | 186126928 | 560 |
| rs10446349 | 0.597 | 186131728 | 561 |
| rs13066369 | 0.518 | 186142625 | 562 |
| rs9870352 | 0.576 | 186146360 | 563 |
| rs4422281 | 0.518 | 186148006 | 564 |
| rs9820111 | 0.518 | 186149057 | 565 |
| rs6784179 | 0.518 | 186152026 | 566 |
| rs7623170 | 0.512 | 186156901 | 567 |
| rs6765821 | 0.524 | 186244971 | 568 |
| rs6783157 | 0.521 | 186252104 | 569 |
| rs12636670 | 0.526 | 186267820 | 570 |

EXAMPLE 20

For individuals with colorectal cancer, the distribution of polymorphic alleles at position 187873329 of chromosome 3, found within the HRG gene, was different from those without colorectal cancer (Table 20). The dominant test for risk associated with carrying the C allele had an empirical p-value based on permutation analysis of 0.003172, and the corresponding dominant odds ratio is 1.456 (Table 20). These data further suggest that this marker, located within the HRG gene, is associated with colorectal cancer risk and that the C allele at position 187873329 of chromosome 3 is associated with an increased risk of developing colorectal cancer.

TABLE 20

| rs no. | 9898 |
|---|---|
| Chromosome; Position | 3; 187873329 |
| Gene Name | HRG |
| SEQ ID NO; Position | 1771; 6830 |
| Genotype; Phenotype | n = C; increased risk |
| Hardy-Weinberg | 0.00984 |

| Case Flag | Allele B | AA | AB | BB | Model | p-Value | Odds Ratio |
|---|---|---|---|---|---|---|---|
| 0 | C | 167 | 481 | 483 | Dominant | 0.003172 | 1.456 |
| 1 | C | 121 | 514 | 503 | | | |

Table 20A indicates SNPs found to be in strong linkage disequilibrium with rs9898. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 20A

Linked SNPs

| SNP | $r^2$ | Position on chr3 | SEQ ID NO |
|---|---|---|---|
| rs3733159 | 0.8 | 187843111 | 571 |
| rs1868154 | 0.574 | 187857373 | 572 |
| rs11720187 | 0.654 | 187860431 | 573 |
| rs9898 | — | 187873329 | 574 |
| rs1042464 | 0.547 | 187878274 | 575 |

EXAMPLE 21

For individuals with colorectal cancer, the distribution of polymorphic alleles at position 4862109 of chromosome 4 was different from those without colorectal cancer (Table 21). The trend test for risk associated with carrying the A allele had an empirical p-value of 0.000489 based on permutation analysis, and the corresponding Mantel-Haenszel odds ratio for trend is 1.464 (Table 21). These data further suggest that this marker is associated with colorectal cancer risk and that the A allele at position 4862109 of chromosome 4 is associated with an increased risk of developing colorectal cancer.

TABLE 21

| rs no. | 10516168 |
|---|---|
| Chromosome; Position | 4; 4862109 |
| Gene Name | |
| SEQ ID NO; Position | ; |
| Genotype; Phenotype | n = A; increased risk |
| Hardy-Weinberg | 0.83766 |

| Case Flag | Allele B | AA | AB | BB | Model | p-Value | Odds Ratio |
|---|---|---|---|---|---|---|---|
| 0 | A | 837 | 157 | 6 | Trend | 0.000489 | 1.464 |
| 1 | A | 776 | 215 | 10 | | | |

Table 21A indicates SNPs found to be in strong linkage disequilibrium with rs10516168. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 21A

Linked SNPs

| SNP | $r^2$ | Position on chr4 | SEQ ID NO |
|---|---|---|---|
| rs6814552 | 0.667 | 4846426 | 576 |
| rs2089781 | 1.0 | 4857130 | 577 |
| rs13149006 | 0.848 | 4857759 | 578 |
| rs10516168 | — | 4862109 | 579 |
| rs767564 | 0.79 | 4867970 | 580 |

EXAMPLE 22

For individuals with colorectal cancer, the distribution of polymorphic alleles at position 73418955 of chromosome 4 was different from those without colorectal cancer (Table 22). The recessive test for risk associated with carrying the G allele had an empirical p-value of 0.003466 based on permutation analysis, and the corresponding recessive odds ratio is 1.478 (Table 22). These data further suggest that this marker is associated with colorectal cancer risk and that the G allele at position 73418955 of chromosome 4 is associated with an increased risk of developing colorectal cancer.

TABLE 22

| rs no. | 10518098 |
|---|---|
| Chromosome; Position | 4; 73418955 |
| Gene Name | |
| SEQ ID NO; Position | ; |
| Genotype; Phenotype | n = G; increased risk |
| Hardy-Weinberg | 0.20305 |

| Case Flag | Allele B | AA | AB | BB | Model | p-Value | Odds Ratio |
|---|---|---|---|---|---|---|---|
| 0 | G | 404 | 459 | 108 | Recessive | 0.003466 | 1.478 |
| 1 | G | 401 | 437 | 155 | | | |

Table 22A indicates SNPs found to be in strong linkage disequilibrium with rs10518098. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 22A

Linked SNPs

| SNP | $r^2$ | Position on chr4 | SEQ ID NO |
|---|---|---|---|
| rs11726886 | 0.533 | 73187634 | 581 |
| rs10518093 | 0.621 | 73200067 | 582 |
| rs4129733 | 0.749 | 73328055 | 583 |
| rs4337703 | 0.749 | 73346262 | 584 |
| rs11733404 | 0.73 | 73346848 | 585 |
| rs11737827 | 0.749 | 73348223 | 586 |
| rs12651098 | 0.738 | 73357454 | 587 |
| rs11734943 | 0.675 | 73363372 | 588 |
| rs9790741 | 0.676 | 73365920 | 589 |
| rs11940196 | 0.925 | 73368604 | 590 |
| rs10755169 | 0.963 | 73376981 | 591 |
| rs11729989 | 0.884 | 73386336 | 592 |
| rs4333153 | 0.963 | 73387894 | 593 |
| rs17775363 | 0.888 | 73401936 | 594 |
| rs17718934 | 0.889 | 73402263 | 595 |
| rs885521 | 0.889 | 73403367 | 596 |
| rs2137735 | 0.889 | 73409745 | 597 |
| rs7675397 | 1.0 | 73418036 | 598 |
| rs10518098 | — | 73418955 | 599 |
| rs1554016 | 1.0 | 73419931 | 600 |
| rs10938007 | 0.91 | 73420592 | 601 |
| rs4444797 | 1.0 | 73420874 | 602 |
| rs4502651 | 1.0 | 73420904 | 603 |
| rs4301078 | 1.0 | 73420954 | 604 |
| rs7700096 | 1.0 | 73421198 | 605 |
| rs7654146 | 1.0 | 73421361 | 606 |
| rs2056022 | 1.0 | 73421626 | 607 |
| rs2056023 | 1.0 | 73421636 | 608 |
| rs2365795 | 1.0 | 73424191 | 609 |
| rs6840004 | 0.926 | 73426574 | 610 |
| rs1121770 | 1.0 | 73428206 | 611 |
| rs11940139 | 1.0 | 73428609 | 612 |
| rs868028 | 1.0 | 73429022 | 613 |
| rs868026 | 1.0 | 73429166 | 614 |
| rs7673208 | 1.0 | 73429961 | 615 |
| rs4694467 | 1.0 | 73430864 | 616 |
| rs4694468 | 0.924 | 73432371 | 617 |
| rs1398982 | 1.0 | 73432662 | 618 |

TABLE 22A-continued

Linked SNPs

| SNP | $r^2$ | Position on chr4 | SEQ ID NO |
|---|---|---|---|
| rs10938009 | 0.926 | 73433172 | 619 |
| rs996154 | 1.0 | 73435810 | 620 |
| rs996153 | 1.0 | 73435851 | 621 |
| rs2365797 | 1.0 | 73437550 | 622 |
| rs1018283 | 1.0 | 73437882 | 623 |
| rs10805048 | 0.926 | 73438096 | 624 |
| rs957047 | 1.0 | 73440758 | 625 |
| rs957046 | 1.0 | 73441001 | 626 |
| rs957045 | 1.0 | 73441029 | 627 |
| rs10008822 | 1.0 | 73442206 | 628 |
| rs4547769 | 1.0 | 73445194 | 629 |
| rs7674709 | 0.835 | 73446950 | 630 |
| rs10938010 | 0.888 | 73448534 | 631 |
| rs4694469 | 0.926 | 73451047 | 632 |
| rs7662481 | 1.0 | 73453617 | 633 |
| rs884511 | 0.89 | 73454336 | 634 |
| rs9685357 | 1.0 | 73455010 | 635 |
| rs10029245 | 0.924 | 73456969 | 636 |
| rs10938012 | 0.925 | 73461427 | 637 |
| rs4694120 | 0.926 | 73468266 | 638 |
| rs10518099 | 0.926 | 73468802 | 639 |
| rs10518100 | 0.89 | 73469693 | 640 |
| rs9985540 | 0.889 | 73472897 | 641 |
| rs985302 | 0.921 | 73473510 | 642 |
| rs2117380 | 0.855 | 73474331 | 643 |
| rs1865383 | 0.816 | 73475459 | 644 |
| rs984406 | 0.842 | 73476824 | 645 |
| rs2175830 | 0.603 | 73481968 | 646 |
| rs1554017 | 0.603 | 73482388 | 647 |
| rs10006866 | 0.603 | 73484550 | 648 |
| rs1513894 | 0.661 | 73489468 | 649 |
| rs11729217 | 0.593 | 73491229 | 650 |
| rs6857543 | 0.662 | 73491598 | 651 |
| rs1398980 | 0.574 | 73492707 | 652 |
| rs7681169 | 0.574 | 73493192 | 653 |
| rs10433664 | 0.574 | 73493907 | 654 |
| rs10050160 | 0.574 | 73496343 | 655 |
| rs6446823 | 0.662 | 73496916 | 656 |
| rs7679388 | 0.574 | 73501955 | 657 |

EXAMPLE 23

For individuals with colorectal cancer, the distribution of polymorphic alleles at position 156010845 of chromosome 4 was different from those without colorectal cancer (Table 23). The dominant test for risk associated with carrying the T allele had an empirical p-value based on permutation analysis of 0.011861, and the corresponding dominant odds ratio is 1.359 (Table 23). These data further suggest that this marker is associated with colorectal cancer risk and that the T allele at position 156010845 of chromosome 4 is associated with an increased risk of developing colorectal cancer.

TABLE 23

| rs no. | 10517602 |
|---|---|
| Chromosome; Position | 4; 156010845 |
| Gene Name | |
| SEQ ID NO; Position | ; |
| Genotype; Phenotype | n = T; increased risk |
| Hardy-Weinberg | 0.04835 |

| Case Flag | Allele B | AA | AB | BB | Model | p-Value | Odds Ratio |
|---|---|---|---|---|---|---|---|
| 0 | T | 825 | 134 | 11 | Dominant | 0.011861 | 1.359 |
| 1 | T | 804 | 180 | 12 | | | |

Table 23A indicates SNPs found to be in strong linkage disequilibrium with rs10517602. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 23A

Linked SNPs

| SNP | $r^2$ | Position on chr4 | SEQ ID NO |
|---|---|---|---|
| rs17031951 | 1.0 | 156007562 | 658 |
| rs17031954 | 1.0 | 156008015 | 659 |
| rs17031957 | 1.0 | 156009501 | 660 |
| rs10517602 | — | 156010845 | 661 |
| rs12501328 | 1.0 | 156019936 | 662 |
| rs1876031 | 1.0 | 156020341 | 663 |
| rs3775785 | 1.0 | 156027459 | 664 |
| rs12507608 | 1.0 | 156029231 | 665 |
| rs17032000 | 1.0 | 156030563 | 666 |
| rs1392546 | 1.0 | 156032538 | 667 |
| rs1500372 | 1.0 | 156033905 | 668 |

EXAMPLE 24

For individuals with colorectal cancer, the distribution of polymorphic alleles at position 114720973 of chromosome 5 was different from those without colorectal cancer (Table 24). The trend test for risk associated with carrying the A allele had an empirical p-value of 0.000444 based on permutation analysis, and the corresponding Mantel-Haenszel odds ratio for trend is 1.252 (Table 24). These data further suggest that this marker is associated with colorectal cancer risk and that the A allele at position 114720973 of chromosome 5 is associated with an increased risk of developing colorectal cancer.

TABLE 24

| rs no. | 2963765 |
|---|---|
| Chromosome; Position | 5; 114720973 |
| Gene Name | |
| SEQ ID NO; Position | ; |
| Genotype; Phenotype | n = A; increased risk |
| Hardy-Weinberg | 0.65318 |

| Case Flag | Allele B | AA | AB | BB | Model | p-Value | Odds Ratio |
|---|---|---|---|---|---|---|---|
| 0 | A | 254 | 478 | 239 | Trend | 0.000444 | 1.252 |
| 1 | A | 207 | 484 | 305 | | | |

Table 24A indicates SNPs found to be in strong linkage disequilibrium with rs2963765. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 24A

Linked SNPs

| SNP | $r^2$ | Position on chr5 | SEQ ID NO |
|---|---|---|---|
| rs269511 | 0.677 | 114716570 | 669 |
| rs12654556 | 0.74 | 114718052 | 670 |
| rs10519405 | 0.525 | 114719100 | 671 |
| rs10519406 | 0.525 | 114719186 | 672 |
| rs2963765 | — | 114720973 | 673 |

TABLE 24A-continued

Linked SNPs

| SNP | $r^2$ | Position on chr5 | SEQ ID NO |
|---|---|---|---|
| rs2964560 | 1.0 | 114721020 | 674 |
| rs269503 | 0.525 | 114724952 | 675 |
| rs10463669 | 0.544 | 114727927 | 676 |
| rs12657417 | 0.525 | 114728598 | 677 |
| rs2925172 | 0.935 | 114729688 | 678 |
| rs17383755 | 0.559 | 114730035 | 679 |
| rs11241322 | 0.9 | 114730402 | 680 |
| rs11241323 | 0.501 | 114731087 | 681 |
| rs2963749 | 0.934 | 114734391 | 682 |
| rs17383865 | 0.932 | 114735264 | 683 |
| rs2963747 | 0.934 | 114735588 | 684 |
| rs17137667 | 0.902 | 114735981 | 685 |
| rs2925170 | 0.934 | 114736503 | 686 |
| rs2591258 | 0.501 | 114737036 | 687 |
| rs11740600 | 0.902 | 114737354 | 688 |
| rs7715232 | 0.505 | 114739954 | 689 |
| rs2198712 | 0.935 | 114741070 | 690 |
| rs10477531 | 0.841 | 114742706 | 691 |
| rs7703997 | 0.615 | 114743558 | 692 |
| rs17137708 | 0.9 | 114743576 | 693 |
| rs13162208 | 0.933 | 114744950 | 694 |
| rs751485 | 0.934 | 114747047 | 695 |
| rs897478 | 0.933 | 114747337 | 696 |
| rs2016888 | 0.902 | 114747490 | 697 |

EXAMPLE 25

For individuals with colorectal cancer, the distribution of polymorphic alleles at position 121110284 of chromosome 5 was different from those without colorectal cancer (Table 25). The trend test for risk associated with carrying the A allele had an empirical p-value of 0.003657 based on permutation analysis, and the corresponding Mantel-Haenszel odds ratio for trend is 1.303 (Table 25). These data further suggest that this marker is associated with colorectal cancer risk and that the A allele at position 121110284 of chromosome 5 is associated with an increased risk of developing colorectal cancer.

TABLE 25

| rs no. | 1988515 |
|---|---|
| Chromosome; Position | 5; 121110284 |
| Gene Name | |
| SEQ ID NO; Position | ; |
| Genotype; Phenotype | n = A; increased risk |
| Hardy-Weinberg | 0.71224 |

| Case Flag | Allele B | AA | AB | BB | Model | p-Value | Odds Ratio |
|---|---|---|---|---|---|---|---|
| 0 | A | 21 | 257 | 700 | Trend | 0.003657 | 1.303 |
| 1 | A | 11 | 216 | 754 | | | |

Table 25A indicates SNPs found to be in strong linkage disequilibrium with rs1988515. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 25A

| Linked SNPs | | | |
|---|---|---|---|
| SNP | $r^2$ | Position on chr5 | SEQ ID NO |
| rs1988515 | — | 121110284 | 698 |

EXAMPLE 26

For individuals with colorectal cancer, the distribution of polymorphic alleles at position 128145987 of chromosome 5 was different from those without colorectal cancer (Table 26). The recessive test for risk associated with carrying the A allele had an empirical p-value of 0.000992 based on permutation analysis, and the corresponding recessive odds ratio is 1.771 (Table 26). These data further suggest that this marker is associated with colorectal cancer risk and that the A allele at position 128145987 of chromosome 5 is associated with an increased risk of developing colorectal cancer.

TABLE 26

| rs no. | 10491268 |
|---|---|
| Chromosome; Position | 5; 128145987 |
| Gene Name | |
| SEQ ID NO; Position | ; |
| Genotype; Phenotype | n = A; increased risk |
| Hardy-Weinberg | 0.24247 |

| Case Flag | Allele B | AA | AB | BB | Model | p-Value | Odds Ratio |
|---|---|---|---|---|---|---|---|
| 0 | A | 547 | 394 | 57 | Recessive | 0.000992 | 1.771 |
| 1 | A | 522 | 382 | 97 | | | |

Table 26A indicates SNPs found to be in strong linkage disequilibrium with rs10491268. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 26A

| Linked SNPs | | | |
|---|---|---|---|
| SNP | $r^2$ | Position on chr5 | SEQ ID NO |
| rs247184 | 0.545 | 128103463 | 699 |
| rs247195 | 0.545 | 128108152 | 700 |
| rs247210 | 0.583 | 128113997 | 701 |
| rs247094 | 0.583 | 128120050 | 702 |
| rs10074635 | 0.503 | 128134369 | 703 |
| rs10061806 | 1.0 | 128135572 | 704 |
| rs7449021 | 1.0 | 128139763 | 705 |
| rs17163935 | 0.56 | 128141175 | 706 |
| rs10491268 | — | 128145987 | 707 |
| rs17790915 | 0.512 | 128146786 | 708 |
| rs1496344 | 0.576 | 128156553 | 709 |
| rs1019137 | 0.545 | 128157693 | 710 |
| rs7735162 | 0.961 | 128160641 | 711 |
| rs7707454 | 0.926 | 128164258 | 712 |
| rs2310808 | 0.545 | 128170372 | 713 |
| rs10066082 | 0.816 | 128197696 | 714 |
| rs10058629 | 0.778 | 128206257 | 715 |
| rs17678073 | 0.778 | 128220969 | 716 |
| rs2214369 | 0.816 | 128223084 | 717 |
| rs6860974 | 0.778 | 128227979 | 718 |
| rs10050439 | 0.778 | 128228401 | 719 |
| rs7723679 | 0.767 | 128232311 | 720 |
| rs7723683 | 0.777 | 128232320 | 721 |

TABLE 26A-continued

| Linked SNPs | | | |
|---|---|---|---|
| SNP | $r^2$ | Position on chr5 | SEQ ID NO |
| rs10079808 | 0.778 | 128233576 | 722 |
| rs1363170 | 0.769 | 128233727 | 723 |
| rs13360809 | 0.778 | 128234493 | 724 |
| rs13356389 | 0.778 | 128234617 | 725 |
| rs17678190 | 0.778 | 128234806 | 726 |
| rs17616306 | 0.778 | 128235438 | 727 |
| rs7712212 | 0.778 | 128235745 | 728 |
| rs7712497 | 0.778 | 128235767 | 729 |
| rs7716412 | 0.778 | 128236078 | 730 |
| rs13362019 | 0.778 | 128236528 | 731 |
| rs9327496 | 0.523 | 128238639 | 732 |
| rs13358000 | 0.778 | 128240119 | 733 |
| rs4469239 | 0.776 | 128241301 | 734 |
| rs13360401 | 0.583 | 128258653 | 735 |
| rs6595867 | 0.578 | 128260778 | 736 |
| rs6873372 | 0.552 | 128260800 | 737 |
| rs6880855 | 0.558 | 128263313 | 738 |
| rs1421889 | 0.61 | 128265259 | 739 |
| rs9285913 | 0.558 | 128269933 | 740 |
| rs10478827 | 0.544 | 128271956 | 741 |
| rs9327500 | 0.591 | 128273703 | 742 |
| rs13436689 | 0.549 | 128279649 | 743 |
| rs13156417 | 0.558 | 128280539 | 744 |
| rs10477690 | 0.555 | 128287628 | 745 |
| rs6867677 | 0.554 | 128289750 | 746 |
| rs6861915 | 0.558 | 128316551 | 747 |
| rs10042256 | 0.567 | 128327389 | 748 |
| rs11740497 | 0.556 | 128340511 | 749 |
| rs10038006 | 0.54 | 128341528 | 750 |
| rs17617241 | 0.516 | 128345166 | 751 |
| rs10065480 | 0.516 | 128346380 | 752 |
| rs11743701 | 0.525 | 128348967 | 753 |
| rs3886286 | 0.525 | 128351543 | 754 |
| rs7735034 | 0.524 | 128352581 | 755 |
| rs7730969 | 0.525 | 128352924 | 756 |
| rs11749027 | 0.558 | 128353107 | 757 |
| rs17679250 | 0.525 | 128355391 | 758 |
| rs17617329 | 0.525 | 128355483 | 759 |
| rs3851463 | 0.525 | 128356081 | 760 |
| rs6859805 | 0.642 | 128358774 | 761 |

EXAMPLE 27

For individuals with colorectal cancer, the distribution of polymorphic alleles at position 1032946 of chromosome 6, found within the LOC285768 gene, was different from those without colorectal cancer (Table 27). The trend test for risk associated with carrying the A allele had an empirical p-value of 0.015463 based on permutation analysis, and the corresponding Mantel-Haenszel odds ratio for trend is 1.199 (Table 27). These data further suggest that this marker, located within the LOC285768 gene, is associated with colorectal cancer risk and that the A allele at position 1032946 of chromosome 6 is associated with an increased risk of developing colorectal cancer.

TABLE 27

| rs no. | 9328033 |
|---|---|
| Chromosome; Position | 6; 1032946 |
| Gene Name | LOC285768 |
| SEQ ID NO; Position | 1772; 13622 |
| Genotype; Phenotype | n = A; increased risk |
| Hardy-Weinberg | 1 |

| Case Flag | Allele B | AA | AB | BB | Model | p-Value | Odds Ratio |
|---|---|---|---|---|---|---|---|
| 0 | A | 59 | 370 | 571 | Trend | 0.015463 | 1.199 |
| 1 | A | 42 | 340 | 620 | | | |

Table 27A indicates SNPs found to be in strong linkage disequilibrium with rs9328033. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 27A

Linked SNPs

| SNP | $r^2$ | Position on chr6 | SEQ ID NO |
|---|---|---|---|
| rs9405439 | 0.795 | 1026731 | 762 |
| rs9391899 | 0.837 | 1032864 | 763 |
| rs9328033 | — | 1032946 | 764 |
| rs7756730 | 0.756 | 1033885 | 765 |
| rs7770094 | 0.756 | 1033964 | 766 |
| rs10900904 | 0.75 | 1034131 | 767 |
| rs10458112 | 0.756 | 1034217 | 768 |
| rs6596783 | 0.744 | 1035056 | 769 |
| rs6914197 | 0.72 | 1035451 | 770 |
| rs9405441 | 0.753 | 1037138 | 771 |
| rs6911992 | 0.72 | 1037761 | 772 |

EXAMPLE 28

For individuals with colorectal cancer, the distribution of polymorphic alleles at position 69521107 of chromosome 6, found within the BAI3 gene, was different from those without colorectal cancer (Table 28). The dominant test for risk associated with carrying the T allele had an empirical p-value based on permutation analysis of 0.00332, and the corresponding dominant odds ratio is 1.378 (Table 28). These data further suggest that this marker, located within the BAI3 gene, is associated with colorectal cancer risk and that the T allele at position 69521107 of chromosome 6 is associated with an increased risk of developing colorectal cancer.

TABLE 28

| rs no. | 10484791 |
|---|---|
| Chromosome; Position | 6; 69521107 |
| Gene Name | BAI3 |
| SEQ ID NO; Position | 1773; 116950 |
| Genotype; Phenotype | n = T; increased risk |
| Hardy-Weinberg | 0.01334 |

| Case Flag | Allele B | AA | AB | BB | Model | p-Value | Odds Ratio |
|---|---|---|---|---|---|---|---|
| 0 | T | 245 | 459 | 295 | Dominant | 0.00332 | 1.378 |
| 1 | T | 191 | 485 | 325 | | | |

Table 28A indicates SNPs found to be in strong linkage disequilibrium with rs10484791. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 28A

Linked SNPs

| SNP | $r^2$ | Position on chr6 | SEQ ID NO |
|---|---|---|---|
| rs9354792 | 0.628 | 69363616 | 773 |
| rs2585614 | 0.595 | 69379328 | 774 |
| rs2246104 | 0.656 | 69411039 | 775 |

TABLE 28A-continued

Linked SNPs

| SNP | $r^2$ | Position on chr6 | SEQ ID NO |
|---|---|---|---|
| rs2585627 | 0.656 | 69414352 | 776 |
| rs2585626 | 0.656 | 69414862 | 777 |
| rs2802694 | 0.807 | 69416925 | 778 |
| rs2253759 | 0.868 | 69428738 | 779 |
| rs2253866 | 0.746 | 69429357 | 780 |
| rs2802689 | 0.865 | 69429728 | 781 |
| rs2585622 | 0.709 | 69435338 | 782 |
| rs2585621 | 0.716 | 69435377 | 783 |
| rs2254654 | 0.837 | 69435704 | 784 |
| rs3121775 | 0.69 | 69436412 | 785 |
| rs6931872 | 0.743 | 69437088 | 786 |
| rs2585592 | 0.656 | 69437132 | 787 |
| rs7754835 | 0.69 | 69437929 | 788 |
| rs2746125 | 0.746 | 69439747 | 789 |
| rs2746127 | 0.746 | 69440936 | 790 |
| rs2585597 | 0.715 | 69445347 | 791 |
| rs2746141 | 0.837 | 69447873 | 792 |
| rs2585598 | 0.69 | 69449271 | 793 |
| rs2802684 | 0.742 | 69454318 | 794 |
| rs2802683 | 0.868 | 69455343 | 795 |
| rs2585599 | 0.733 | 69461590 | 796 |
| rs2802680 | 0.776 | 69462851 | 797 |
| rs2585600 | 0.718 | 69463179 | 798 |
| rs2585604 | 0.776 | 69469800 | 799 |
| rs2746132 | 0.718 | 69471343 | 800 |
| rs715294 | 0.744 | 69483117 | 801 |
| rs2802676 | 0.901 | 69483590 | 802 |
| rs12206222 | 0.717 | 69486083 | 803 |
| rs12210045 | 0.776 | 69490498 | 804 |
| rs10945138 | 0.901 | 69496298 | 805 |
| rs7768591 | 0.901 | 69497479 | 806 |
| rs11752837 | 0.776 | 69504298 | 807 |
| rs11752398 | 0.718 | 69504487 | 808 |
| rs10945139 | 0.775 | 69511710 | 809 |
| rs12154008 | 0.776 | 69513299 | 810 |
| rs7745837 | 0.813 | 69517615 | 811 |
| rs12201488 | 0.813 | 69518419 | 812 |
| rs10484791 | — | 69521107 | 813 |

EXAMPLE 29

For individuals with colorectal cancer, the distribution of polymorphic alleles at position 83088471 of chromosome 6 was different from those without colorectal cancer (Table 29). The dominant test for risk associated with carrying the T allele had an empirical p-value based on permutation analysis of 0.001403, and the corresponding dominant odds ratio is 1.335 (Table 29). These data further suggest that this marker is associated with colorectal cancer risk and that the T allele at position 83088471 of chromosome 6 is associated with an increased risk of developing colorectal cancer.

TABLE 29

| rs no. | 508106 |
|---|---|
| Chromosome; Position | 6; 83088471 |
| Gene Name | |
| SEQ ID NO; Position | ; |
| Genotype; Phenotype | n = T; increased risk |
| Hardy-Weinberg | 0.64887 |

| Case Flag | Allele B | AA | AB | BB | Model | p-Value | Odds Ratio |
|---|---|---|---|---|---|---|---|
| 0 | T | 496 | 409 | 90 | Dominant | 0.001403 | 1.335 |
| 1 | T | 425 | 460 | 111 | | | |

Table 29A indicates SNPs found to be in strong linkage disequilibrium with rs508106. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 29A

Linked SNPs

| SNP | $r^2$ | Position on chr6 | SEQ ID NO |
|---|---|---|---|
| rs2323642 | 0.644 | 82950808 | 814 |
| rs540814 | 0.544 | 83037702 | 815 |
| rs2753211 | 0.692 | 83052756 | 816 |
| rs2753212 | 0.69 | 83052893 | 817 |
| rs9344267 | 0.792 | 83059529 | 818 |
| rs62953 | 0.763 | 83059811 | 819 |
| rs529833 | 0.748 | 83063355 | 820 |
| rs544734 | 0.958 | 83065585 | 821 |
| rs554594 | 0.958 | 83065715 | 822 |
| rs511002 | 1.0 | 83066965 | 823 |
| rs507500 | 0.919 | 83067321 | 824 |
| rs532219 | 1.0 | 83079412 | 825 |
| rs577767 | 0.958 | 83086171 | 826 |
| rs526833 | 0.957 | 83086772 | 827 |
| rs7756828 | 1.0 | 83087733 | 828 |
| rs508106 | — | 83088471 | 829 |
| rs555844 | 0.919 | 83089659 | 830 |
| rs1923137 | 1.0 | 83092525 | 831 |
| rs1923138 | 0.957 | 83092537 | 832 |
| rs723142 | 1.0 | 83094274 | 833 |
| rs2180742 | 1.0 | 83094499 | 834 |
| rs1547614 | 0.958 | 83094576 | 835 |
| rs2145368 | 1.0 | 83095347 | 836 |
| rs2180743 | 1.0 | 83095565 | 837 |
| rs7762072 | 0.955 | 83095939 | 838 |
| rs13191698 | 0.919 | 83096974 | 839 |
| rs13207433 | 0.958 | 83097004 | 840 |
| rs1321622 | 0.876 | 83097222 | 841 |
| rs9353066 | 0.919 | 83098262 | 842 |
| rs6907015 | 0.958 | 83098329 | 843 |
| rs6930014 | 0.958 | 83098352 | 844 |
| rs9353067 | 0.876 | 83100260 | 845 |
| rs9353068 | 1.0 | 83101000 | 846 |
| rs2024996 | 0.876 | 83103870 | 847 |
| rs12527551 | 0.877 | 83104741 | 848 |
| rs9344270 | 0.919 | 83105428 | 849 |
| rs796398 | 0.958 | 83113039 | 850 |
| rs770904 | 0.913 | 83114887 | 851 |
| rs770897 | 0.782 | 83120523 | 852 |
| rs770898 | 0.75 | 83122607 | 853 |
| rs770894 | 0.773 | 83126442 | 854 |
| rs770895 | 0.773 | 83127291 | 855 |
| rs1570140 | 0.754 | 83129590 | 856 |
| rs770911 | 0.754 | 83131084 | 857 |
| rs1275806 | 0.658 | 83137358 | 858 |
| rs770906 | 0.517 | 83140060 | 859 |
| rs932614 | 0.517 | 83146661 | 860 |
| rs9344274 | 0.508 | 83147795 | 861 |
| rs1951006 | 0.52 | 83150543 | 862 |
| rs9449462 | 0.507 | 83153296 | 863 |
| rs9361914 | 0.505 | 83155501 | 864 |
| rs714133 | 0.52 | 83162032 | 865 |
| rs1998204 | 0.508 | 83163350 | 866 |
| rs1853143 | 0.508 | 83165082 | 867 |
| rs4706945 | 0.52 | 83165771 | 868 |
| rs9449469 | 0.52 | 83167427 | 869 |
| rs9449470 | 0.544 | 83167802 | 870 |
| rs4706948 | 0.505 | 83168404 | 871 |
| rs2875128 | 0.532 | 83169297 | 872 |
| rs6912008 | 0.508 | 83169493 | 873 |
| rs9449475 | 0.556 | 83170215 | 874 |
| rs967730 | 0.553 | 83170490 | 875 |
| rs967731 | 0.544 | 83170598 | 876 |
| rs9361923 | 0.508 | 83172329 | 877 |

EXAMPLE 30

For individuals with colorectal cancer, the distribution of polymorphic alleles at position 83094274 of chromosome 6 was different from those without colorectal cancer (Table 30). The dominant test for risk associated with carrying the T allele had an empirical p-value based on permutation analysis of 0.001298, and the corresponding dominant odds ratio is 1.337 (Table 30). These data further suggest that this marker is associated with colorectal cancer risk and that the T allele at position 83094274 of chromosome 6 is associated with an increased risk of developing colorectal cancer.

TABLE 30

| rs no. | 723142 |
|---|---|
| Chromosome; Position | 6; 83094274 |
| Gene Name | |
| SEQ ID NO; Position | ; |
| Genotype; Phenotype | n = T; increased risk |
| Hardy-Weinberg | 0.49209 |

| Case Flag | Allele B | AA | AB | BB | Model | p-Value | Odds Ratio |
|---|---|---|---|---|---|---|---|
| 0 | T | 501 | 404 | 91 | Dominant | 0.001298 | 1.337 |
| 1 | T | 430 | 458 | 110 | | | |

Table 30A indicates SNPs found to be in strong linkage disequilibrium with rs723142. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 30A

Linked SNPs

| SNP | $r^2$ | Position on chr6 | SEQ ID NO |
|---|---|---|---|
| rs2323642 | 0.621 | 82950808 | 814 |
| rs540814 | 0.553 | 83037702 | 815 |
| rs2753211 | 0.698 | 83052756 | 816 |
| rs2753212 | 0.696 | 83052893 | 817 |
| rs9344267 | 0.797 | 83059529 | 818 |
| rs62953 | 0.768 | 83059811 | 819 |
| rs529833 | 0.754 | 83063355 | 820 |
| rs544734 | 0.959 | 83065585 | 821 |
| rs554594 | 0.959 | 83065715 | 822 |
| rs511002 | 1.0 | 83066965 | 823 |
| rs507500 | 0.921 | 83067321 | 824 |
| rs532219 | 1.0 | 83079412 | 825 |
| rs577767 | 0.959 | 83086171 | 826 |
| rs526833 | 0.958 | 83086772 | 827 |
| rs7756828 | 1.0 | 83087733 | 828 |
| rs508106 | 1.0 | 83088471 | 829 |
| rs555844 | 0.921 | 83089659 | 830 |
| rs1923137 | 1.0 | 83092525 | 831 |
| rs1923138 | 0.958 | 83092537 | 832 |
| rs723142 | — | 83094274 | 833 |
| rs2180742 | 1.0 | 83094499 | 834 |
| rs1547614 | 0.959 | 83094576 | 835 |
| rs2145368 | 1.0 | 83095347 | 836 |
| rs2180743 | 1.0 | 83095565 | 837 |
| rs7762072 | 0.956 | 83095939 | 838 |
| rs13191698 | 0.921 | 83096974 | 839 |
| rs13207433 | 0.959 | 83097004 | 840 |
| rs1321622 | 0.879 | 83097222 | 841 |
| rs9353066 | 0.921 | 83098262 | 842 |
| rs6907015 | 0.959 | 83098329 | 843 |
| rs6930014 | 0.959 | 83098352 | 844 |
| rs9353067 | 0.879 | 83100260 | 845 |
| rs9353068 | 1.0 | 83101000 | 846 |
| rs2024996 | 0.879 | 83103870 | 847 |
| rs12527551 | 0.88 | 83104741 | 848 |
| rs9344270 | 0.921 | 83105428 | 849 |
| rs796398 | 0.959 | 83113039 | 850 |
| rs770904 | 0.916 | 83114887 | 851 |
| rs770897 | 0.786 | 83120523 | 852 |

TABLE 30A-continued

| Linked SNPs | | | |
|---|---|---|---|
| SNP | r² | Position on chr6 | SEQ ID NO |
| rs770898 | 0.755 | 83122607 | 853 |
| rs770894 | 0.778 | 83126442 | 854 |
| rs770895 | 0.778 | 83127291 | 855 |
| rs1570140 | 0.759 | 83129590 | 856 |
| rs770911 | 0.759 | 83131084 | 857 |
| rs1275806 | 0.664 | 83137358 | 858 |
| rs770906 | 0.525 | 83140060 | 859 |
| rs932614 | 0.525 | 83146661 | 860 |
| rs9344274 | 0.517 | 83147795 | 861 |
| rs1951006 | 0.528 | 83150543 | 862 |
| rs9449462 | 0.515 | 83153296 | 863 |
| rs9361914 | 0.514 | 83155501 | 864 |
| rs714133 | 0.528 | 83162032 | 865 |
| rs1998204 | 0.517 | 83163350 | 866 |
| rs1853143 | 0.517 | 83165082 | 867 |
| rs4706945 | 0.528 | 83165771 | 868 |
| rs9449469 | 0.528 | 83167427 | 869 |
| rs9449470 | 0.552 | 83167802 | 870 |
| rs4706948 | 0.514 | 83168404 | 871 |
| rs2875128 | 0.541 | 83169297 | 872 |
| rs6912008 | 0.517 | 83169493 | 873 |
| rs9449475 | 0.565 | 83170215 | 874 |
| rs967730 | 0.562 | 83170490 | 875 |
| rs967731 | 0.552 | 83170598 | 876 |
| rs9361923 | 0.517 | 83172329 | 877 |

EXAMPLE 31

For individuals with colorectal cancer, the distribution of polymorphic alleles at position 129960703 of chromosome 6, found within the ARHGAP18 gene, was different from those without colorectal cancer (Table 31). The trend test for risk associated with carrying the C allele had an empirical p-value of 0.000525 based on permutation analysis, and the corresponding Mantel-Haenszel odds ratio for trend is 1.358 (Table 31). These data further suggest that this marker, located within the ARHGAP18 gene, is associated with colorectal cancer risk and that the C allele at position 129960703 of chromosome 6 is associated with an increased risk of developing colorectal cancer.

TABLE 31

| rs no. | 10499162 |
|---|---|
| Chromosome; Position | 6; 129960703 |
| Gene Name | ARHGAP18 |
| SEQ ID NO; Position | 1774; 112361 |
| Genotype; Phenotype | n = C; increased risk |
| Hardy-Weinberg | 0.16957 |

| Case Flag | Allele B | AA | AB | BB | Model | p-Value | Odds Ratio |
|---|---|---|---|---|---|---|---|
| 0 | C | 746 | 215 | 9 | Trend | 0.000525 | 1.358 |
| 1 | C | 704 | 266 | 24 | | | |

Table 31A indicates SNPs found to be in strong linkage disequilibrium with rs10499162. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 31A

| Linked SNPs | | | |
|---|---|---|---|
| SNP | r² | Position on chr6 | SEQ ID NO |
| rs9385502 | 0.928 | 129960436 | 878 |
| rs10499162 | — | 129960703 | 879 |
| rs9402145 | 1.0 | 129962477 | 880 |
| rs9375636 | 0.635 | 129970245 | 881 |

EXAMPLE 32

For individuals with colorectal cancer, the distribution of polymorphic alleles at position 11585877 of chromosome 7, found within the KIAA0960 gene, was different from those without colorectal cancer (Table 32). The recessive test for risk associated with carrying the G allele had an empirical p-value of 0.008011 based on permutation analysis, and the corresponding recessive odds ratio is 1.596 (Table 32). These data further suggest that this marker, located within the KIAA0960 gene, is associated with colorectal cancer risk and that the G allele at position 11585877 of chromosome 7 is associated with an increased risk of developing colorectal cancer.

TABLE 32

| rs no. | 2355084 |
|---|---|
| Chromosome; Position | 7; 11585877 |
| Gene Name | KIAA0960 |
| SEQ ID NO; Position | 1775; 339055 |
| Genotype; Phenotype | n = G; increased risk |
| Hardy-Weinberg | 0.27870 |

| Case Flag | Allele B | AA | AB | BB | Model | p-Value | Odds Ratio |
|---|---|---|---|---|---|---|---|
| 0 | G | 545 | 393 | 58 | Recessive | 0.008011 | 1.596 |
| 1 | G | 526 | 386 | 90 | | | |

Table 32A indicates SNPs found to be in strong linkage disequilibrium with rs2355084. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 32A

| Linked SNPs | | | |
|---|---|---|---|
| SNP | r² | Position on chr7 | SEQ ID NO |
| rs2355084 | — | 11585877 | 882 |

EXAMPLE 33

For individuals with colorectal cancer, the distribution of polymorphic alleles at position 81559837 of chromosome 7, found within the CACNA2D1 gene, was different from those without colorectal cancer (Table 33). The dominant test for risk associated with carrying the C allele had an empirical p-value based on permutation analysis of 0.008433, and the corresponding dominant odds ratio is 1.455 (Table 33). These data further suggest that this marker, located within the CACNA2D1 gene, is associated with colorectal cancer risk and that the C allele at position 81559837 of chromosome 7 is associated with an increased risk of developing colorectal cancer.

TABLE 33

| rs no. | 10280428 |
|---|---|
| Chromosome; Position | 7; 81559837 |
| Gene Name | CACNA2D1 |
| SEQ ID NO; Position | 1776; 157620 |
| Genotype; Phenotype | n = C; increased risk |
| Hardy-Weinberg | 0.01828 |

| Case Flag | Allele B | AA | AB | BB | Model | p-Value | Odds Ratio |
|---|---|---|---|---|---|---|---|
| 0 | C | 872 | 91 | 7 | Dominant | 0.008433 | 1.455 |
| 1 | C | 856 | 138 | 2 | | | |

Table 33A indicates SNPs found to be in strong linkage disequilibrium with rs10280428. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 33A

| | Linked SNPs | | |
|---|---|---|---|
| SNP | $r^2$ | Position on chr7 | SEQ ID NO |
| rs11768310 | 0.88 | 81554149 | 883 |
| rs10279911 | 0.915 | 81559478 | 884 |
| rs10280428 | — | 81559837 | 885 |
| rs11763784 | 1.0 | 81641687 | 886 |
| rs11768220 | 0.901 | 81648931 | 887 |
| rs11770457 | 0.88 | 81654315 | 888 |

EXAMPLE 34

For individuals with colorectal cancer, the distribution of polymorphic alleles at position 144767960 of chromosome 7 was different from those without colorectal cancer (Table 34). The dominant test for risk associated with carrying the T allele had an empirical p-value based on permutation analysis of 0.006242, and the corresponding dominant odds ratio is 1.590 (Table 34). These data further suggest that this marker is associated with colorectal cancer risk and that the T allele at position 144767960 of chromosome 7 is associated with an increased risk of developing colorectal cancer.

TABLE 34

| rs no. | 850470 |
|---|---|
| Chromosome; Position | 7; 144767960 |
| Gene Name | |
| SEQ ID NO; Position | ; |
| Genotype; Phenotype | n = T; increased risk |
| Hardy-Weinberg | 0.07590 |

| Case Flag | Allele B | AA | AB | BB | Model | p-Value | Odds Ratio |
|---|---|---|---|---|---|---|---|
| 0 | T | 95 | 386 | 517 | Dominant | 0.006242 | 1.590 |
| 1 | T | 62 | 422 | 515 | | | |

Table 34A indicates SNPs found to be in strong linkage disequilibrium with rs850470. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 34A

| | Linked SNPs | | |
|---|---|---|---|
| SNP | $r^2$ | Position on chr7 | SEQ ID NO |
| rs12532655 | 0.538 | 144628286 | 889 |
| rs12534416 | 0.538 | 144628318 | 890 |
| rs7805406 | 0.546 | 144628632 | 891 |
| rs12533991 | 0.538 | 144629754 | 892 |
| rs12533483 | 0.538 | 144629965 | 893 |
| rs6968614 | 0.574 | 144630098 | 894 |
| rs12374872 | 0.574 | 144635813 | 895 |
| rs6968911 | 0.582 | 144643683 | 896 |
| rs7784182 | 0.574 | 144645286 | 897 |
| rs10280300 | 0.574 | 144646697 | 898 |
| rs6964491 | 0.7 | 144669590 | 899 |
| rs6951319 | 0.695 | 144669600 | 900 |
| rs1357620 | 0.701 | 144671926 | 901 |
| rs12531013 | 0.748 | 144672558 | 902 |
| rs6952652 | 0.701 | 144674138 | 903 |
| rs16882782 | 0.701 | 144676045 | 904 |
| rs17169751 | 0.698 | 144676393 | 905 |
| rs1357624 | 0.701 | 144678594 | 906 |
| rs1357623 | 0.701 | 144678612 | 907 |
| rs17169752 | 0.701 | 144680315 | 908 |
| rs17169763 | 0.885 | 144718311 | 909 |
| rs17169765 | 0.913 | 144720727 | 910 |
| rs6960519 | 0.513 | 144733732 | 911 |
| rs850456 | 0.72 | 144733992 | 912 |
| rs850455 | 0.884 | 144734180 | 913 |
| rs850454 | 0.884 | 144734239 | 914 |
| rs850452 | 0.885 | 144734742 | 915 |
| rs850450 | 0.885 | 144738529 | 916 |
| rs850505 | 0.85 | 144744457 | 917 |
| rs850502 | 0.885 | 144745645 | 918 |
| rs850500 | 0.956 | 144745774 | 919 |
| rs850499 | 0.885 | 144745875 | 920 |
| rs850493 | 0.957 | 144751586 | 921 |
| rs850492 | 0.958 | 144752182 | 922 |
| rs850491 | 0.961 | 144752705 | 923 |
| rs850490 | 0.957 | 144753415 | 924 |
| rs850489 | 0.961 | 144753565 | 925 |
| rs850488 | 0.961 | 144754173 | 926 |
| rs850487 | 0.957 | 144755233 | 927 |
| rs850486 | 0.961 | 144755604 | 928 |
| rs850485 | 0.961 | 144755775 | 929 |
| rs850483 | 0.961 | 144756961 | 930 |
| rs850482 | 0.961 | 144757255 | 931 |
| rs850480 | 1.0 | 144759437 | 932 |
| rs850478 | 0.961 | 144760563 | 933 |
| rs850476 | 0.961 | 144761726 | 934 |
| rs850474 | 0.96 | 144766026 | 935 |
| rs850472 | 0.961 | 144766794 | 936 |
| rs850470 | — | 144767960 | 937 |
| rs850468 | 0.693 | 144768118 | 938 |
| rs850467 | 1.0 | 144768579 | 939 |
| rs850466 | 1.0 | 144768715 | 940 |
| rs850462 | 0.857 | 144770877 | 941 |
| rs850461 | 0.85 | 144770905 | 942 |
| rs850458 | 0.844 | 144771574 | 943 |
| rs850457 | 0.854 | 144771653 | 944 |
| rs860333 | 0.854 | 144771867 | 945 |
| rs10246840 | 0.854 | 144774486 | 946 |
| rs6952320 | 0.847 | 144774883 | 947 |
| rs1079789 | 0.852 | 144776678 | 948 |
| rs10952623 | 0.857 | 144777538 | 949 |
| rs1468582 | 0.857 | 144778707 | 950 |
| rs2372057 | 0.851 | 144781332 | 951 |
| rs10952624 | 0.857 | 144781771 | 952 |
| rs733171 | 0.857 | 144782495 | 953 |
| rs10952625 | 0.857 | 144783026 | 954 |
| rs12667814 | 0.618 | 144783666 | 955 |
| rs6976909 | 0.857 | 144784599 | 956 |
| rs2079830 | 0.849 | 144785299 | 957 |
| rs12154287 | 0.533 | 144788902 | 958 |
| rs1990347 | 0.857 | 144791211 | 959 |

TABLE 34A-continued

Linked SNPs

| SNP | $r^2$ | Position on chr7 | SEQ ID NO |
|---|---|---|---|
| rs10267840 | 0.857 | 144793063 | 960 |
| rs10808035 | 0.857 | 144796105 | 961 |
| rs11763425 | 0.857 | 144799583 | 962 |
| rs2191275 | 0.887 | 144799675 | 963 |
| rs12535408 | 0.856 | 144800213 | 964 |
| rs6961951 | 0.857 | 144800438 | 965 |
| rs6962101 | 0.857 | 144800519 | 966 |
| rs6979892 | 0.805 | 144800830 | 967 |
| rs12703731 | 0.58 | 144801300 | 968 |
| rs6951436 | 0.857 | 144802085 | 969 |
| rs11761238 | 0.821 | 144802576 | 970 |
| rs10228710 | 0.857 | 144803188 | 971 |
| rs7810370 | 0.857 | 144803650 | 972 |
| rs6464691 | 0.857 | 144804012 | 973 |
| rs6962254 | 0.857 | 144804167 | 974 |
| rs2888244 | 0.854 | 144805193 | 975 |
| rs4285408 | 0.857 | 144805467 | 976 |
| rs11764219 | 0.857 | 144806025 | 977 |
| rs6944748 | 0.857 | 144806327 | 978 |
| rs6969500 | 0.809 | 144806354 | 979 |
| rs10952627 | 0.857 | 144808010 | 980 |
| rs6966867 | 0.857 | 144810732 | 981 |
| rs10237200 | 0.849 | 144814121 | 982 |
| rs10266218 | 0.846 | 144814527 | 983 |
| rs850571 | 0.852 | 144818301 | 984 |
| rs850570 | 0.857 | 144819907 | 985 |

EXAMPLE 35

For individuals with colorectal cancer, the distribution of polymorphic alleles at position 149242026 of chromosome 7 was different from those without colorectal cancer (Table 35). The recessive test for risk associated with carrying the G allele had an empirical p-value of 0.001661 based on permutation analysis, and the corresponding recessive odds ratio is 1.418 (Table 35). These data further suggest that this marker is associated with colorectal cancer risk and that the G allele at position 149242026 of chromosome 7 is associated with an increased risk of developing colorectal cancer.

TABLE 35

| rs no. | 3864498 |
|---|---|
| Chromosome; Position | 7; 149242026 |
| Gene Name | |
| SEQ ID NO; Position | ; |
| Genotype; Phenotype | n = G; increased risk |
| Hardy-Weinberg | 0.48562 |

| Case Flag | Allele B | AA | AB | BB | Model | p-Value | Odds Ratio |
|---|---|---|---|---|---|---|---|
| 0 | G | 20 | 215 | 704 | Recessive | 0.001661 | 1.418 |
| 1 | G | 17 | 168 | 786 | | | |

Table 35A indicates SNPs found to be in strong linkage disequilibrium with rs3864498. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 35A

Linked SNPs

| SNP | $r^2$ | Position on chr7 | SEQ ID NO |
|---|---|---|---|
| rs4015699 | 0.699 | 149201414 | 986 |
| rs4725865 | 0.779 | 149210939 | 987 |
| rs13227764 | 0.687 | 149213761 | 988 |
| rs4367449 | 0.543 | 149214960 | 989 |
| rs6947979 | 0.844 | 149219765 | 990 |
| rs3864498 | — | 149242026 | 991 |
| rs4406321 | 0.907 | 149242664 | 992 |
| rs17173853 | 0.92 | 149243724 | 993 |

EXAMPLE 36

For individuals with colorectal cancer, the distribution of polymorphic alleles at position 4257764 of chromosome 8, found within the CSMD1 gene, was different from those without colorectal cancer (Table 36). The recessive test for risk associated with carrying the A allele had an empirical p-value of 0.025004 based on permutation analysis, and the corresponding recessive odds ratio is 1.228 (Table 36). These data further suggest that this marker, located within the CSMD1 gene, is associated with colorectal cancer risk and that the A allele at position 4257764 of chromosome 8 is associated with an increased risk of developing colorectal cancer.

TABLE 36

| rs no. | 10503262 |
|---|---|
| Chromosome; Position | 8; 4257764 |
| Gene Name | CSMD1 |
| SEQ ID NO; Position | 1777; 581973 |
| Genotype; Phenotype | n = A; increased risk |
| Hardy-Weinberg | 0.27772 |

| Case Flag | Allele B | AA | AB | BB | Model | p-Value | Odds Ratio |
|---|---|---|---|---|---|---|---|
| 0 | A | 72 | 360 | 539 | Recessive | 0.025004 | 1.228 |
| 1 | A | 63 | 330 | 602 | | | |

Table 36A indicates SNPs found to be in strong linkage disequilibrium with rs10503262. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 36A

Linked SNPs

| SNP | $r^2$ | Position on chr8 | SEQ ID NO |
|---|---|---|---|
| rs10089026 | 0.958 | 4252805 | 994 |
| rs10092807 | 1.0 | 4257185 | 995 |
| rs10503262 | — | 4257764 | 996 |

EXAMPLE 37

For individuals with colorectal cancer, the distribution of polymorphic alleles at position 9440613 of chromosome 8 was different from those without colorectal cancer (Table 37). The trend test for risk associated with carrying the A allele had an empirical p-value of 0.049874 based on permutation analysis, and the corresponding Mantel-Haenszel odds ratio for trend is 1.144 (Table 37). These data further suggest that this marker is associated with colorectal cancer risk and that the A allele at position 9440613 of chromosome 8 is associated with an increased risk of developing colorectal cancer.

TABLE 37

| rs no. | 6601328 |
| --- | --- |
| Chromosome; Position | 8; 9440613 |
| Gene Name | |
| SEQ ID NO; Position | ; |
| Genotype; Phenotype | n = A; increased risk |
| Hardy-Weinberg | 0.08727 |

| Case Flag | Allele B | AA | AB | BB | Model | p-Value | Odds Ratio |
| --- | --- | --- | --- | --- | --- | --- | --- |
| 0 | A | 26 | 252 | 931 | Trend | 0.049874 | 1.144 |
| 1 | A | 8 | 248 | 974 | | | |

Table 37A indicates SNPs found to be in strong linkage disequilibrium with rs6601328. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 37A

Linked SNPs

| SNP | $r^2$ | Position on chr8 | SEQ ID NO |
| --- | --- | --- | --- |
| rs17150201 | 0.88 | 9426711 | 997 |
| rs1471203 | 0.803 | 9431741 | 998 |
| rs7009486 | 0.891 | 9436057 | 999 |
| rs13261395 | 1.0 | 9436101 | 1000 |
| rs4841169 | 0.891 | 9436786 | 1001 |
| rs4840423 | 1.0 | 9437029 | 1002 |
| rs4841171 | 1.0 | 9437099 | 1003 |
| rs11785485 | 1.0 | 9439838 | 1004 |
| rs7388554 | 0.88 | 9440072 | 1005 |
| rs6601328 | — | 9440613 | 1006 |
| rs11781665 | 1.0 | 9444872 | 1007 |
| rs7013834 | 1.0 | 9452052 | 1008 |
| rs13274310 | 1.0 | 9458679 | 1009 |
| rs13265363 | 0.891 | 9460336 | 1010 |
| rs11784858 | 0.785 | 9463104 | 1011 |
| rs13270240 | 0.847 | 9468129 | 1012 |
| rs11775432 | 1.0 | 9480306 | 1013 |
| rs4551359 | 1.0 | 9503674 | 1014 |
| rs11774818 | 1.0 | 9523873 | 1015 |
| rs4841186 | 1.0 | 9526021 | 1016 |
| rs4840432 | 1.0 | 9526193 | 1017 |
| rs4535743 | 0.891 | 9529470 | 1018 |
| rs11994018 | 1.0 | 9531111 | 1019 |
| rs11991547 | 1.0 | 9538857 | 1020 |
| rs7839648 | 0.891 | 9541393 | 1021 |
| rs4128324 | 1.0 | 9546289 | 1022 |
| rs1393 | 1.0 | 9549119 | 1023 |
| rs11780274 | 1.0 | 9558649 | 1024 |
| rs13250838 | 1.0 | 9563755 | 1025 |
| rs13264510 | 1.0 | 9568067 | 1026 |
| rs13261385 | 1.0 | 9568084 | 1027 |
| rs4570159 | 1.0 | 9568712 | 1028 |
| rs13259379 | 0.891 | 9640154 | 1029 |
| rs4289816 | 0.88 | 9645506 | 1030 |
| rs17734024 | 0.891 | 9673180 | 1031 |

EXAMPLE 38

For individuals with colorectal cancer, the distribution of polymorphic alleles at position 55701610 of chromosome 8, found within the RP1 gene, was different from those without colorectal cancer (Table 38). The recessive test for risk associated with carrying the G allele had an empirical p-value of 0.003739 based on permutation analysis, and the corresponding recessive odds ratio is 1.279 (Table 38). These data further suggest that this marker, located within the RP1 gene, is associated with colorectal cancer risk and that the G allele at position 55701610 of chromosome 8 is associated with an increased risk of developing colorectal cancer.

TABLE 38

| rs no. | 444772 |
| --- | --- |
| Chromosome; Position | 8; 55701610 |
| Gene Name | RP1 |
| SEQ ID NO; Position | 1778; 10431 |
| Genotype; Phenotype | n = G; increased risk |
| Hardy-Weinberg | 0.88723 |

| Case Flag | Allele B | AA | AB | BB | Model | p-Value | Odds Ratio |
| --- | --- | --- | --- | --- | --- | --- | --- |
| 0 | G | 102 | 471 | 554 | Recessive | 0.003739 | 1.279 |
| 1 | G | 87 | 421 | 628 | | | |

Table 38A indicates SNPs found to be in strong linkage disequilibrium with rs444772. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 38A

Linked SNPs

| SNP | $r^2$ | Position on chr8 | SEQ ID NO |
| --- | --- | --- | --- |
| rs421844 | 0.95 | 55688038 | 1032 |
| rs435326 | 0.952 | 55688723 | 1033 |
| rs396881 | 0.954 | 55688788 | 1034 |
| rs446102 | 0.954 | 55689106 | 1035 |
| rs702761 | 1.0 | 55691506 | 1036 |
| rs145290 | 1.0 | 55692165 | 1037 |
| rs428854 | 1.0 | 55698923 | 1038 |
| rs429668 | 1.0 | 55699691 | 1039 |
| rs444772 | — | 55701610 | 1040 |
| rs446227 | 1.0 | 55704003 | 1041 |
| rs414352 | 1.0 | 55704066 | 1042 |
| rs441800 | 1.0 | 55704170 | 1043 |
| rs388912 | 1.0 | 55714151 | 1044 |
| rs376055 | 1.0 | 55718398 | 1045 |
| rs448744 | 1.0 | 55720864 | 1046 |
| rs433265 | 1.0 | 55724371 | 1047 |
| rs421469 | 1.0 | 55724624 | 1048 |
| rs383666 | 1.0 | 55725409 | 1049 |
| rs509273 | 1.0 | 55729655 | 1050 |
| rs428630 | 1.0 | 55732233 | 1051 |
| rs369565 | 1.0 | 55734727 | 1052 |
| rs858428 | 1.0 | 55734972 | 1053 |
| rs499324 | 1.0 | 55735628 | 1054 |
| rs409429 | 1.0 | 55735791 | 1055 |
| rs426380 | 0.909 | 55736905 | 1056 |
| rs439539 | 1.0 | 55738068 | 1057 |
| rs433881 | 1.0 | 55740834 | 1058 |
| rs437439 | 1.0 | 55741606 | 1059 |
| rs450496 | 1.0 | 55742554 | 1060 |
| rs446153 | 1.0 | 55747804 | 1061 |
| rs453186 | 1.0 | 55748460 | 1062 |
| rs371043 | 1.0 | 55752508 | 1063 |
| rs394020 | 1.0 | 55760756 | 1064 |
| rs395862 | 1.0 | 55761309 | 1065 |
| rs858396 | 1.0 | 55776456 | 1066 |
| rs893361 | 1.0 | 55783865 | 1067 |
| rs6473950 | 0.955 | 55801936 | 1068 |
| rs1437785 | 0.955 | 55811566 | 1069 |
| rs2043774 | 0.955 | 55819136 | 1070 |

TABLE 38A-continued

Linked SNPs

| SNP | r² | Position on chr8 | SEQ ID NO |
|---|---|---|---|
| rs7000259 | 0.955 | 55821626 | 1071 |
| rs4737673 | 0.955 | 55823685 | 1072 |
| rs1509678 | 0.955 | 55825618 | 1073 |
| rs2375220 | 0.955 | 55845129 | 1074 |
| rs1553764 | 0.955 | 55858095 | 1075 |
| rs1498181 | 0.955 | 55861650 | 1076 |
| rs1498182 | 0.866 | 55870126 | 1077 |
| rs1039842 | 0.955 | 55880446 | 1078 |
| rs9298510 | 0.955 | 55883850 | 1079 |
| rs1498189 | 0.802 | 55886453 | 1080 |

EXAMPLE 39

For individuals with colorectal cancer, the distribution of polymorphic alleles at position 105447572 of chromosome 8 was different from those without colorectal cancer (Table 39). The dominant test for risk associated with carrying the G allele had an empirical p-value based on permutation analysis of 0.0698, and the corresponding dominant odds ratio is 1.184 (Table 39). These data further suggest that this marker is associated with colorectal cancer risk and that the G allele at position 105447572 of chromosome 8 is associated with an increased risk of developing colorectal cancer.

TABLE 39

| rs no. | 2853129 |
|---|---|
| Chromosome; Position | 8; 105447572 |
| Gene Name | |
| SEQ ID NO; Position | ; |
| Genotype; Phenotype | n = G; increased risk |
| Hardy-Weinberg | 0.13044 |

| Case Flag | Allele B | AA | AB | BB | Model | p-Value | Odds Ratio |
|---|---|---|---|---|---|---|---|
| 0 | G | 917 | 264 | 27 | Dominant | 0.0698 | 1.184 |
| 1 | G | 894 | 312 | 24 | | | |

Table 39A indicates SNPs found to be in strong linkage disequilibrium with rs2853129. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 39A

Linked SNPs

| SNP | r² | Position on chr8 | SEQ ID NO |
|---|---|---|---|
| rs2853129 | — | 105447572 | 1081 |

EXAMPLE 40

For individuals with colorectal cancer, the distribution of polymorphic alleles at position 128476287 of chromosome 8 was different from those without colorectal cancer (Table 40). The trend test for risk associated with carrying the C allele had an empirical p-value of 0.021659 based on permutation analysis, and the corresponding Mantel-Haenszel odds ratio for trend is 1.305 (Table 40). These data further suggest that this marker is associated with colorectal cancer risk and that the C allele at position 128476287 of chromosome 8 is associated with an increased risk of developing colorectal cancer.

TABLE 40

| rs no. | 16902149 |
|---|---|
| Chromosome; Position | 8; 128476287 |
| Gene Name | |
| SEQ ID NO; Position | ; |
| Genotype; Phenotype | n = C; increased risk |
| Hardy-Weinberg | 0.04399 |

| Case Flag | Allele B | AA | AB | BB | Model | p-Value | Odds Ratio |
|---|---|---|---|---|---|---|---|
| 0 | C | 959 | 124 | 0 | Trend | 0.021659 | 1.305 |
| 1 | C | 824 | 134 | 5 | | | |

Table 40A indicates SNPs found to be in strong linkage disequilibrium with rs16902149. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 40A

Linked SNPs

| SNP | r² | Position on chr8 | SEQ ID NO |
|---|---|---|---|
| rs16902149 | — | 128476287 | 1082 |
| rs17467139 | 1.0 | 128481192 | 1089 |

EXAMPLE 41

For individuals with colorectal cancer, the distribution of polymorphic alleles at position 128476625 of chromosome 8 was different from those without colorectal cancer (Table 41). The trend test for risk associated with carrying the A allele had an empirical p-value of 0.000282 based on permutation analysis, and the corresponding Mantel-Haenszel odds ratio for trend is 1.264 (Table 41). These data further suggest that this marker is associated with colorectal cancer risk and that the A allele at position 128476625 of chromosome 8 is associated with an increased risk of developing colorectal cancer.

TABLE 41

| rs no. | 10505477 |
|---|---|
| Chromosome; Position | 8; 128476625 |
| Gene Name | |
| SEQ ID NO; Position | ; |
| Genotype; Phenotype | n = A; increased risk |
| Hardy-Weinberg | 1 |

| Case Flag | Allele B | AA | AB | BB | Model | p-Value | Odds Ratio |
|---|---|---|---|---|---|---|---|
| 0 | A | 251 | 486 | 234 | Trend | 0.000282 | 1.264 |
| 1 | A | 209 | 478 | 309 | | | |

Table 41A indicates SNPs found to be in strong linkage disequilibrium with rs10505477. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 41A

Linked SNPs

| SNP | $r^2$ | Position on chr8 | SEQ ID NO |
|---|---|---|---|
| rs10505477 | — | 128476625 | 1084 |
| rs10808556 | 0.627 | 128482329 | 1090 |
| rs6983267 | 0.935 | 128482487 | 1091 |
| rs3847137 | 0.598 | 128483680 | 1092 |
| rs10505474 | 0.632 | 128486686 | 1094 |
| rs2060776 | 0.609 | 128489299 | 1096 |
| rs4871788 | 0.609 | 128490967 | 1097 |
| rs7837328 | 0.609 | 128492309 | 1098 |
| rs7837626 | 0.609 | 128492523 | 1099 |
| rs7837644 | 0.609 | 128492580 | 1100 |
| rs10956368 | 0.586 | 128492832 | 1101 |
| rs10956369 | 0.609 | 128492999 | 1102 |
| rs871135 | 0.609 | 128495575 | 1104 |

EXAMPLE 42

For individuals with colorectal cancer, the distribution of polymorphic alleles at position 128477298 of chromosome 8 was different from those without colorectal cancer (Table 42). The dominant test for risk associated with carrying the T allele had an empirical p-value based on permutation analysis of 0.001921, and the corresponding dominant odds ratio is 1.337 (Table 42). These data further suggest that this marker is associated with colorectal cancer risk and that the T allele at position 128477298 of chromosome 8 is associated with an increased risk of developing colorectal cancer.

TABLE 42

| | |
|---|---|
| rs no. | 10505476 |
| Chromosome; Position | 8; 128477298 |
| Gene Name | |
| SEQ ID NO; Position | ; |
| Genotype; Phenotype | n = T; increased risk |
| Hardy-Weinberg | 0.19082 |

| Case Flag | Allele B | AA | AB | BB | Model | p-Value | Odds Ratio |
|---|---|---|---|---|---|---|---|
| 0 | T | 480 | 357 | 52 | Dominant | 0.001921 | 1.337 |
| 1 | T | 439 | 434 | 66 | | | |

Table 42A indicates SNPs found to be in strong linkage disequilibrium with rs10505476. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 42A

Linked SNPs

| SNP | $r^2$ | Position on chr8 | SEQ ID NO |
|---|---|---|---|
| rs10505476 | — | 128477298 | 1086 |
| rs10808556 | 0.602 | 128482329 | 1090 |
| rs3847137 | 0.557 | 128483680 | 1092 |
| rs10505474 | 0.579 | 128486686 | 1094 |
| rs2060776 | 0.601 | 128489299 | 1096 |
| rs4871788 | 0.601 | 128490967 | 1097 |
| rs7837328 | 0.601 | 128492309 | 1098 |
| rs7837626 | 0.601 | 128492523 | 1099 |
| rs7837644 | 0.601 | 128492580 | 1100 |

TABLE 42A-continued

Linked SNPs

| SNP | $r^2$ | Position on chr8 | SEQ ID NO |
|---|---|---|---|
| rs10956368 | 0.557 | 128492832 | 1101 |
| rs10956369 | 0.601 | 128492999 | 1102 |
| rs871135 | 0.601 | 128495575 | 1104 |

EXAMPLE 43

For individuals with colorectal cancer, the distribution of polymorphic alleles at position 128483680 of chromosome 8 was different from those without colorectal cancer (Table 43). The trend test for risk associated with carrying the C allele had an empirical p-value of 0.004512 based on permutation analysis, and the corresponding Mantel-Haenszel odds ratio for trend is 1.193 (Table 43). These data further suggest that this marker is associated with colorectal cancer risk and that the C allele at position 128483680 of chromosome 8 is associated with an increased risk of developing colorectal cancer.

TABLE 43

| | |
|---|---|
| rs no. | 3847137 |
| Chromosome; Position | 8; 128483680 |
| Gene Name | |
| SEQ ID NO; Position | ; |
| Genotype; Phenotype | n = C; increased risk |
| Hardy-Weinberg | 0.40673 |

| Case Flag | Allele B | AA | AB | BB | Model | p-Value | Odds Ratio |
|---|---|---|---|---|---|---|---|
| 0 | C | 359 | 521 | 169 | Trend | 0.004512 | 1.193 |
| 1 | C | 313 | 518 | 214 | | | |

Table 43A indicates SNPs found to be in strong linkage disequilibrium with rs3847137. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 43A

Linked SNPs

| SNP | $r^2$ | Position on chr8 | SEQ ID NO |
|---|---|---|---|
| rs3847136 | 0.581 | 128476372 | 1083 |
| rs10505477 | 0.598 | 128476625 | 1084 |
| rs10505476 | 0.557 | 128477298 | 1086 |
| rs11985829 | 0.524 | 128478414 | 1087 |
| rs10808556 | 0.956 | 128482329 | 1090 |
| rs6983267 | 0.556 | 128482487 | 1091 |
| rs3847137 | — | 128483680 | 1092 |
| rs7013278 | 0.663 | 128484074 | 1093 |
| rs10505474 | 0.963 | 128486686 | 1094 |
| rs2060776 | 0.928 | 128489299 | 1096 |
| rs4871788 | 0.928 | 128490967 | 1097 |
| rs7837328 | 0.928 | 128492309 | 1098 |
| rs7837626 | 0.928 | 128492523 | 1099 |
| rs7837644 | 0.928 | 128492580 | 1100 |
| rs10956368 | 0.893 | 128492832 | 1101 |
| rs10956369 | 0.928 | 128492999 | 1102 |
| rs7014346 | 0.701 | 128493974 | 1103 |
| rs871135 | 0.928 | 128495575 | 1104 |

EXAMPLE 44

For individuals with colorectal cancer, the distribution of polymorphic alleles at position 128486686 of chromosome 8 was different from those without colorectal cancer (Table 44). The trend test for risk associated with carrying the T allele had an empirical p-value of 0.004329 based on permutation analysis, and the corresponding Mantel-Haenszel odds ratio for trend is 1.199 (Table 44). These data further suggest that this marker is associated with colorectal cancer risk and that the T allele at position 128486686 of chromosome 8 is associated with an increased risk of developing colorectal cancer.

TABLE 44

| rs no. | 10505474 |
| Chromosome; Position | 8; 128486686 |
| Gene Name | |
| SEQ ID NO; Position | ; |
| Genotype; Phenotype | n = T; increased risk |
| Hardy-Weinberg | 0.64397 |

| Case Flag | Allele B | AA | AB | BB | Model | p-Value | Odds Ratio |
|---|---|---|---|---|---|---|---|
| 0 | T | 355 | 485 | 155 | Trend | 0.004329 | 1.199 |
| 1 | T | 308 | 482 | 198 | | | |

Table 44A indicates SNPs found to be in strong linkage disequilibrium with rs10505474. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 44A

Linked SNPs

| SNP | $r^2$ | Position on chr8 | SEQ ID NO |
|---|---|---|---|
| rs3847136 | 0.608 | 128476372 | 1083 |
| rs10505477 | 0.632 | 128476625 | 1084 |
| rs10505476 | 0.579 | 128477298 | 1086 |
| rs11985829 | 0.545 | 128478414 | 1087 |
| rs10808556 | 1.0 | 128482329 | 1090 |
| rs6983267 | 0.591 | 128482487 | 1091 |
| rs3847137 | 0.963 | 128483680 | 1092 |
| rs7013278 | 0.695 | 128484074 | 1093 |
| rs10505474 | — | 128486686 | 1094 |
| rs2060776 | 0.963 | 128489299 | 1096 |
| rs4871788 | 0.963 | 128490967 | 1097 |
| rs7837328 | 0.963 | 128492309 | 1098 |
| rs7837626 | 0.963 | 128492523 | 1099 |
| rs7837644 | 0.963 | 128492580 | 1100 |
| rs10956368 | 0.927 | 128492832 | 1101 |
| rs10956369 | 0.963 | 128492999 | 1102 |
| rs7014346 | 0.727 | 128493974 | 1103 |
| rs871135 | 0.963 | 128495575 | 1104 |

EXAMPLE 45

For individuals with colorectal cancer, the distribution of polymorphic alleles at position 128487118 of chromosome 8 was different from those without colorectal cancer (Table 45). The dominant test for risk associated with carrying the T allele had an empirical p-value based on permutation analysis of 0.008718, and the corresponding dominant odds ratio is 1.293 (Table 45). These data further suggest that this marker is associated with colorectal cancer risk and that the T allele at position 128487118 of chromosome 8 is associated with an increased risk of developing colorectal cancer.

TABLE 45

| rs no. | 10505473 |
| Chromosome; Position | 8; 128487118 |
| Gene Name | |
| SEQ ID NO; Position | ; |
| Genotype; Phenotype | n = T; increased risk |
| Hardy-Weinberg | 0.20587 |

| Case Flag | Allele B | AA | AB | BB | Model | p-Value | Odds Ratio |
|---|---|---|---|---|---|---|---|
| 0 | T | 722 | 262 | 16 | Dominant | 0.008718 | 1.293 |
| 1 | T | 669 | 312 | 21 | | | |

Table 45A indicates SNPs found to be in strong linkage disequilibrium with rs10505473. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 45A

Linked SNPs

| SNP | $r^2$ | Position on chr8 | SEQ ID NO |
|---|---|---|---|
| rs12334317 | 1.0 | 128477246 | 1085 |
| rs10505473 | — | 128487118 | 1095 |
| rs9297756 | 0.841 | 128509349 | 1106 |
| rs7357368 | 1.0 | 128512569 | 1107 |
| rs7831606 | 0.69 | 128524876 | 1108 |

EXAMPLE 46

For individuals with colorectal cancer, the distribution of polymorphic alleles at position 128492832 of chromosome 8 was different from those without colorectal cancer (Table 46). The trend test for risk associated with carrying the T allele had an empirical p-value of 0.006508 based on permutation analysis, and the corresponding Mantel-Haenszel odds ratio for trend is 1.180 (Table 46). These data further suggest that this marker is associated with colorectal cancer risk and that the T allele at position 128492832 of chromosome 8 is associated with an increased risk of developing colorectal cancer.

TABLE 46

| rs no. | 10956368 |
| Chromosome; Position | 8; 128492832 |
| Gene Name | |
| SEQ ID NO; Position | ; |
| Genotype; Phenotype | n = T; increased risk |
| Hardy-Weinberg | 0.60762 |

| Case Flag | Allele B | AA | AB | BB | Model | p-Value | Odds Ratio |
|---|---|---|---|---|---|---|---|
| 0 | T | 393 | 519 | 159 | Trend | 0.006508 | 1.180 |
| 1 | T | 347 | 509 | 203 | | | |

Table 46A indicates SNPs found to be in strong linkage disequilibrium with rs10956368. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 46A

Linked SNPs

| SNP | r² | Position on chr8 | SEQ ID NO |
|---|---|---|---|
| rs10505477 | 0.586 | 128476625 | 1084 |
| rs10505476 | 0.557 | 128477298 | 1086 |
| rs10808556 | 0.911 | 128482329 | 1090 |
| rs6983267 | 0.548 | 128482487 | 1091 |
| rs3847137 | 0.893 | 128483680 | 1092 |
| rs7013278 | 0.586 | 128484074 | 1093 |
| rs10505474 | 0.927 | 128486686 | 1094 |
| rs2060776 | 0.962 | 128489299 | 1096 |
| rs4871788 | 0.962 | 128490967 | 1097 |
| rs7837328 | 0.962 | 128492309 | 1098 |
| rs7837626 | 0.962 | 128492523 | 1099 |
| rs7837644 | 0.962 | 128492580 | 1100 |
| rs10956368 | — | 128492832 | 1101 |
| rs10956369 | 0.962 | 128492999 | 1102 |
| rs7014346 | 0.713 | 128493974 | 1103 |
| rs871135 | 0.962 | 128495575 | 1104 |

EXAMPLE 47

For individuals with colorectal cancer, the distribution of polymorphic alleles at position 128492999 of chromosome 8 was different from those without colorectal cancer (Table 47). The trend test for risk associated with carrying the T allele had an empirical p-value of 0.002283 based on permutation analysis, and the corresponding Mantel-Haenszel odds ratio for trend is 1.208 (Table 47). These data further suggest that this marker is associated with colorectal cancer risk and that the T allele at position 128492999 of chromosome 8 is associated with an increased risk of developing colorectal cancer.

TABLE 47

| | |
|---|---|
| rs no. | 10956369 |
| Chromosome; Position | 8; 128492999 |
| Gene Name | |
| SEQ ID NO; Position | ; |
| Genotype; Phenotype | n = T; increased risk |
| Hardy-Weinberg | 0.56463 |

| Case Flag | Allele B | AA | AB | BB | Model | p-Value | Odds Ratio |
|---|---|---|---|---|---|---|---|
| 0 | T | 375 | 518 | 165 | Trend | 0.002283 | 1.208 |
| 1 | T | 322 | 516 | 211 | | | |

Table 47A indicates SNPs found to be in strong linkage disequilibrium with rs10956369. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 47A

Linked SNPs

| SNP | r² | Position on chr8 | SEQ ID NO |
|---|---|---|---|
| rs3847136 | 0.553 | 128476372 | 1083 |
| rs10505477 | 0.609 | 128476625 | 1084 |
| rs10505476 | 0.601 | 128477298 | 1086 |
| rs10808556 | 0.955 | 128482329 | 1090 |
| rs6983267 | 0.569 | 128482487 | 1091 |
| rs3847137 | 0.928 | 128483680 | 1092 |
| rs7013278 | 0.64 | 128484074 | 1093 |
| rs10505474 | 0.963 | 128486686 | 1094 |
| rs2060776 | 1.0 | 128489299 | 1096 |
| rs4871788 | 1.0 | 128490967 | 1097 |
| rs7837328 | 1.0 | 128492309 | 1098 |
| rs7837626 | 1.0 | 128492523 | 1099 |
| rs7837644 | 1.0 | 128492580 | 1100 |
| rs10956368 | 0.962 | 128492832 | 1101 |
| rs10956369 | — | 128492999 | 1102 |
| rs7014346 | 0.755 | 128493974 | 1103 |
| rs871135 | 1.0 | 128495575 | 1104 |

EXAMPLE 48

For individuals with colorectal cancer, the distribution of polymorphic alleles at position 128493974 of chromosome 8 was different from those without colorectal cancer (Table 48). The recessive test for risk associated with carrying the A allele had an empirical p-value of 0.000759 based on permutation analysis, and the corresponding recessive odds ratio is 1.529 (Table 48). These data further suggest that this marker is associated with colorectal cancer risk and that the A allele at position 128493974 of chromosome 8 is associated with an increased risk of developing colorectal cancer.

TABLE 48

| | |
|---|---|
| rs no. | 7014346 |
| Chromosome; Position | 8; 128493974 |
| Gene Name | |
| SEQ ID NO; Position | ; |
| Genotype; Phenotype | n = A; increased risk |
| Hardy-Weinberg | 0.09641 |

| Case Flag | Allele B | AA | AB | BB | Model | p-Value | Odds Ratio |
|---|---|---|---|---|---|---|---|
| 0 | A | 429 | 517 | 124 | Recessive | 0.000759 | 1.529 |
| 1 | A | 378 | 505 | 177 | | | |

Table 48A indicates SNPs found to be in strong linkage disequilibrium with rs7014346. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 48A

Linked SNPs

| SNP | r² | Position on chr8 | SEQ ID NO |
|---|---|---|---|
| rs3847136 | 0.714 | 128476372 | 1083 |
| rs11985829 | 0.644 | 128478414 | 1087 |
| rs10808555 | 0.505 | 128478693 | 1088 |
| rs10808556 | 0.748 | 128482329 | 1090 |
| rs3847137 | 0.701 | 128483680 | 1092 |
| rs7013278 | 0.944 | 128484074 | 1093 |
| rs10505474 | 0.727 | 128486686 | 1094 |
| rs2060776 | 0.755 | 128489299 | 1096 |
| rs4871788 | 0.755 | 128490967 | 1097 |
| rs7837328 | 0.755 | 128492309 | 1098 |
| rs7837626 | 0.755 | 128492523 | 1099 |

TABLE 48A-continued

Linked SNPs

| SNP | r² | Position on chr8 | SEQ ID NO |
|---|---|---|---|
| rs7837644 | 0.755 | 128492580 | 1100 |
| rs10956368 | 0.713 | 128492832 | 1101 |
| rs10956369 | 0.755 | 128492999 | 1102 |
| rs7014346 | — | 128493974 | 1103 |
| rs871135 | 0.755 | 128495575 | 1104 |
| rs7842552 | 0.642 | 128500876 | 1105 |

EXAMPLE 49

For individuals with colorectal cancer, the distribution of polymorphic alleles at position 128500876 of chromosome 8 was different from those without colorectal cancer (Table 49).

The trend test for risk associated with carrying the G allele had an empirical p-value of 0.002018 based on permutation analysis, and the corresponding Mantel-Haenszel odds ratio for trend is 1.240 (Table 49). These data further suggest that this marker is associated with colorectal cancer risk and that the G allele at position 128500876 of chromosome 8 is associated with an increased risk of developing colorectal cancer.

TABLE 49

| rs no. | 7842552 |
|---|---|
| Chromosome; Position | 8; 128500876 |
| Gene Name | |
| SEQ ID NO; Position | ; |
| Genotype; Phenotype | n = G; increased risk |
| Hardy-Weinberg | 0.87942 |

| Case Flag | Allele B | AA | AB | BB | Model | p-Value | Odds Ratio |
|---|---|---|---|---|---|---|---|
| 0 | G | 510 | 424 | 85 | Trend | 0.002018 | 1.240 |
| 1 | G | 430 | 450 | 107 | | | |

Table 49A indicates SNPs found to be in strong linkage disequilibrium with rs7842552. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 49A

Linked SNPs

| SNP | r² | Position on chr8 | SEQ ID NO |
|---|---|---|---|
| rs7013278 | 0.53 | 128484074 | 1093 |
| rs7014346 | 0.642 | 128493974 | 1103 |
| rs7842552 | — | 128500876 | 1105 |

EXAMPLE 50

For individuals with colorectal cancer, the distribution of polymorphic alleles at position 138583352 of chromosome 8 was different from those without colorectal cancer (Table 50).

The recessive test for risk associated with carrying the C allele had an empirical p-value of 0.000829 based on permutation analysis, and the corresponding recessive odds ratio is 2.664 (Table 50). These data further suggest that this marker is associated with colorectal cancer risk and that the C allele at position 138583352 of chromosome 8 is associated with an increased risk of developing colorectal cancer.

TABLE 50

| rs no. | 1399176 |
|---|---|
| Chromosome; Position | 8; 138583352 |
| Gene Name | |
| SEQ ID NO; Position | ; |
| Genotype; Phenotype | n = C; increased risk |
| Hardy-Weinberg | 0.04904 |

| Case Flag | Allele B | AA | AB | BB | Model | p-Value | Odds Ratio |
|---|---|---|---|---|---|---|---|
| 0 | C | 686 | 269 | 15 | Recessive | 0.000829 | 2.664 |
| 1 | C | 666 | 290 | 40 | | | |

Table 50A indicates SNPs found to be in strong linkage disequilibrium with rs1399176. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 50A

Linked SNPs

| SNP | r² | Position on chr8 | SEQ ID NO |
|---|---|---|---|
| rs4909649 | 0.835 | 138448609 | 1109 |
| rs4909652 | 0.835 | 138448978 | 1110 |
| rs7000235 | 0.835 | 138450507 | 1111 |
| rs7833216 | 0.835 | 138450935 | 1112 |
| rs6986763 | 0.835 | 138451287 | 1113 |
| rs4265216 | 0.821 | 138452272 | 1114 |
| rs4391470 | 0.835 | 138452507 | 1115 |
| rs13249389 | 0.834 | 138452835 | 1116 |
| rs10102751 | 0.835 | 138453471 | 1117 |
| rs4532628 | 0.835 | 138454113 | 1118 |
| rs4279630 | 0.829 | 138454197 | 1119 |
| rs4474054 | 0.835 | 138454235 | 1120 |
| rs4909654 | 0.835 | 138454833 | 1121 |
| rs4292724 | 0.835 | 138455486 | 1122 |
| rs12541665 | 0.835 | 138455728 | 1123 |
| rs4909657 | 0.82 | 138456184 | 1124 |
| rs4909367 | 0.652 | 138456296 | 1125 |
| rs7820493 | 0.835 | 138456395 | 1126 |
| rs7837229 | 0.835 | 138457265 | 1127 |
| rs13253269 | 0.83 | 138458205 | 1128 |
| rs7014387 | 0.835 | 138458287 | 1129 |
| rs7826913 | 0.835 | 138458607 | 1130 |
| rs6577786 | 0.835 | 138459228 | 1131 |
| rs7835685 | 0.835 | 138459736 | 1132 |
| rs4909658 | 0.833 | 138460258 | 1133 |
| rs4909659 | 0.835 | 138460320 | 1134 |
| rs4909660 | 0.835 | 138460491 | 1135 |
| rs6577788 | 0.835 | 138461455 | 1136 |
| rs6577789 | 0.835 | 138461471 | 1137 |
| rs7845225 | 0.835 | 138461926 | 1138 |
| rs7827162 | 0.835 | 138462319 | 1139 |
| rs4131207 | 0.796 | 138467267 | 1140 |
| rs4131208 | 0.835 | 138467277 | 1141 |
| rs7016247 | 0.835 | 138467539 | 1142 |
| rs7007938 | 0.835 | 138469853 | 1143 |
| rs10875404 | 0.835 | 138469883 | 1144 |
| rs6577790 | 0.835 | 138472916 | 1145 |
| rs4909665 | 0.835 | 138473941 | 1146 |
| rs6577792 | 0.828 | 138477490 | 1147 |
| rs4582597 | 0.681 | 138481482 | 1148 |
| rs10098545 | 0.819 | 138482393 | 1149 |
| rs2943199 | 0.86 | 138490184 | 1150 |
| rs2960100 | 0.835 | 138498734 | 1151 |
| rs11166725 | 0.958 | 138545196 | 1152 |
| rs17629911 | 0.958 | 138546484 | 1153 |

TABLE 50A-continued

Linked SNPs

| SNP | r² | Position on chr8 | SEQ ID NO |
|---|---|---|---|
| rs10505682 | 0.837 | 138551497 | 1154 |
| rs17632067 | 1.0 | 138576626 | 1155 |
| rs11786383 | 1.0 | 138578139 | 1156 |
| rs11773949 | 0.628 | 138580074 | 1157 |
| rs1399176 | — | 138583352 | 1158 |
| rs10505684 | 0.628 | 138585809 | 1159 |
| rs7816962 | 0.628 | 138585968 | 1160 |
| rs6577803 | 0.606 | 138586498 | 1161 |
| rs6996799 | 0.606 | 138588282 | 1162 |
| rs17683816 | 0.959 | 138590203 | 1163 |
| rs12677749 | 0.959 | 138590751 | 1164 |
| rs6981747 | 0.957 | 138594903 | 1165 |
| rs6998164 | 0.959 | 138598108 | 1166 |
| rs4384013 | 0.958 | 138601596 | 1167 |
| rs4625065 | 0.959 | 138601771 | 1168 |
| rs11786764 | 0.959 | 138603600 | 1169 |
| rs11786786 | 0.959 | 138603658 | 1170 |
| rs11776612 | 0.959 | 138603708 | 1171 |
| rs1913453 | 0.959 | 138604408 | 1172 |
| rs17684894 | 0.959 | 138604979 | 1173 |
| rs17633888 | 0.959 | 138607006 | 1174 |
| rs17633935 | 0.959 | 138607169 | 1175 |
| rs17685141 | 0.956 | 138607178 | 1176 |
| rs12677813 | 0.959 | 138608732 | 1177 |
| rs11780534 | 0.959 | 138610100 | 1178 |
| rs11777429 | 0.958 | 138610110 | 1179 |
| rs17634044 | 0.959 | 138610517 | 1180 |
| rs11166729 | 0.959 | 138611185 | 1181 |
| rs1514199 | 0.959 | 138611655 | 1182 |
| rs1514200 | 0.954 | 138611699 | 1183 |
| rs1514201 | 0.953 | 138611757 | 1184 |
| rs11780105 | 0.954 | 138612308 | 1185 |
| rs12375358 | 0.959 | 138614096 | 1186 |
| rs10505685 | 0.958 | 138614490 | 1187 |
| rs17685382 | 0.959 | 138614687 | 1188 |
| rs17634252 | 0.959 | 138615037 | 1189 |
| rs17634276 | 0.957 | 138615093 | 1190 |
| rs11778762 | 0.959 | 138615852 | 1191 |
| rs1514202 | 0.954 | 138616621 | 1192 |
| rs1514203 | 0.959 | 138616711 | 1193 |
| rs1514204 | 0.959 | 138616778 | 1194 |

EXAMPLE 51

For individuals with colorectal cancer, the distribution of polymorphic alleles at position 138614490 of chromosome 8 was different from those without colorectal cancer (Table 51). The recessive test for risk associated with carrying the C allele had an empirical p-value of 0.002867 based on permutation analysis, and the corresponding recessive odds ratio is 2.258 (Table 51). These data further suggest that this marker is associated with colorectal cancer risk and that the C allele at position 138614490 of chromosome 8 is associated with an increased risk of developing colorectal cancer.

TABLE 51

| rs no. | 10505685 |
|---|---|
| Chromosome; Position | 8; 138614490 |
| Gene Name | |
| SEQ ID NO; Position | ; |
| Genotype; Phenotype | n = C; increased risk |
| Hardy-Weinberg | 0.12615 |

| Case Flag | Allele B | AA | AB | BB | Model | p-Value | Odds Ratio |
|---|---|---|---|---|---|---|---|
| 0 | C | 673 | 278 | 19 | Recessive | 0.002867 | 2.258 |
| 1 | C | 654 | 299 | 43 | | | |

Table 51A indicates SNPs found to be in strong linkage disequilibrium with rs10505685. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 51A

Linked SNPs

| SNP | r² | Position on chr8 | SEQ ID NO |
|---|---|---|---|
| rs4909649 | 0.794 | 138448609 | 1109 |
| rs4909652 | 0.794 | 138448978 | 1110 |
| rs7000235 | 0.794 | 138450507 | 1111 |
| rs7833216 | 0.794 | 138450935 | 1112 |
| rs6986763 | 0.794 | 138451287 | 1113 |
| rs4265216 | 0.777 | 138452272 | 1114 |
| rs4391470 | 0.794 | 138452507 | 1115 |
| rs13249389 | 0.793 | 138452835 | 1116 |
| rs10102751 | 0.794 | 138453471 | 1117 |
| rs4532628 | 0.794 | 138454113 | 1118 |
| rs4279630 | 0.788 | 138454197 | 1119 |
| rs44474054 | 0.794 | 138454235 | 1120 |
| rs4909654 | 0.794 | 138454833 | 1121 |
| rs4292724 | 0.794 | 138455486 | 1122 |
| rs12541665 | 0.794 | 138455728 | 1123 |
| rs4909657 | 0.776 | 138456184 | 1124 |
| rs4909367 | 0.641 | 138456296 | 1125 |
| rs7820493 | 0.794 | 138456395 | 1126 |
| rs7837229 | 0.794 | 138457265 | 1127 |
| rs13253269 | 0.789 | 138458205 | 1128 |
| rs7014387 | 0.794 | 138458287 | 1129 |
| rs7826913 | 0.794 | 138458607 | 1130 |
| rs6577786 | 0.794 | 138459228 | 1131 |
| rs7835685 | 0.794 | 138459736 | 1132 |
| rs4909658 | 0.792 | 138460258 | 1133 |
| rs4909659 | 0.794 | 138460320 | 1134 |
| rs4909660 | 0.794 | 138460491 | 1135 |
| rs6577788 | 0.794 | 138461455 | 1136 |
| rs6577789 | 0.794 | 138461471 | 1137 |
| rs7845225 | 0.794 | 138461926 | 1138 |
| rs7827162 | 0.794 | 138462319 | 1139 |
| rs4131207 | 0.755 | 138467267 | 1140 |
| rs4131208 | 0.794 | 138467277 | 1141 |
| rs7016247 | 0.794 | 138467539 | 1142 |
| rs7007938 | 0.794 | 138469853 | 1143 |
| rs10875404 | 0.794 | 138469883 | 1144 |
| rs6577790 | 0.794 | 138472916 | 1145 |
| rs4909665 | 0.794 | 138473941 | 1146 |
| rs6577792 | 0.786 | 138477490 | 1147 |
| rs4582297 | 0.643 | 138481482 | 1148 |
| rs10098545 | 0.774 | 138482393 | 1149 |
| rs2943199 | 0.815 | 138490184 | 1150 |
| rs2960100 | 0.794 | 138498734 | 1151 |
| rs11166725 | 0.916 | 138545196 | 1152 |
| rs17629911 | 0.916 | 138546484 | 1153 |
| rs10505682 | 0.797 | 138551497 | 1154 |
| rs17632067 | 0.957 | 138576626 | 1155 |
| rs11786383 | 0.958 | 138578139 | 1156 |
| rs11773949 | 0.585 | 138580074 | 1157 |
| rs1399176 | 0.958 | 138583352 | 1158 |
| rs10505684 | 0.585 | 138585809 | 1159 |
| rs7816962 | 0.585 | 138585968 | 1160 |
| rs6577803 | 0.626 | 138586498 | 1161 |
| rs6996799 | 0.626 | 138588282 | 1162 |
| rs17683816 | 1.0 | 138590203 | 1163 |
| rs12677749 | 1.0 | 138590751 | 1164 |
| rs6981747 | 1.0 | 138594903 | 1165 |
| rs6998164 | 1.0 | 138598108 | 1166 |
| rs4384013 | 0.957 | 138601596 | 1167 |
| rs4625065 | 1.0 | 138601771 | 1168 |
| rs11786764 | 1.0 | 138603600 | 1169 |
| rs11786786 | 1.0 | 138603658 | 1170 |
| rs11776612 | 1.0 | 138603708 | 1171 |
| rs1913453 | 1.0 | 138604408 | 1172 |
| rs17684894 | 1.0 | 138604979 | 1173 |

TABLE 51A-continued

Linked SNPs

| SNP | $r^2$ | Position on chr8 | SEQ ID NO |
|---|---|---|---|
| rs17633888 | 1.0 | 138607006 | 1174 |
| rs17633935 | 1.0 | 138607169 | 1175 |
| rs17685141 | 1.0 | 138607178 | 1176 |
| rs12677813 | 1.0 | 138608732 | 1177 |
| rs11780534 | 1.0 | 138610100 | 1178 |
| rs11777429 | 1.0 | 138610110 | 1179 |
| rs17634044 | 1.0 | 138610517 | 1180 |
| rs11166729 | 1.0 | 138611185 | 1181 |
| rs1514199 | 1.0 | 138611655 | 1182 |
| rs1514200 | 1.0 | 138611699 | 1183 |
| rs1514201 | 1.0 | 138611757 | 1184 |
| rs11780105 | 1.0 | 138612308 | 1185 |
| rs12375358 | 1.0 | 138614096 | 1186 |
| rs10505685 | — | 138614490 | 1187 |
| rs17685382 | 1.0 | 138614687 | 1188 |
| rs17634252 | 1.0 | 138615037 | 1189 |
| rs17634276 | 1.0 | 138615093 | 1190 |
| rs11778762 | 1.0 | 138615852 | 1191 |
| rs1514202 | 1.0 | 138616621 | 1192 |
| rs1514203 | 1.0 | 138616711 | 1193 |
| rs1514204 | 1.0 | 138616778 | 1194 |

EXAMPLE 52

For individuals with colorectal cancer, the distribution of polymorphic alleles at position 141587219 of chromosome 8 was different from those without colorectal cancer (Table 52). The dominant test for risk associated with carrying the A allele had an empirical p-value based on permutation analysis of 0.0772, and the corresponding dominant odds ratio is 1.172 (Table 52). These data further suggest that this marker is associated with colorectal cancer risk and that the A allele at position 141587219 of chromosome 8 is associated with an increased risk of developing colorectal cancer.

TABLE 52

| rs no. | 1057083 |
|---|---|
| Chromosome; Position | 8; 141587219 |
| Gene Name | |
| SEQ ID NO; Position | ; |
| Genotype; Phenotype | n = A; increased risk |
| Hardy-Weinberg | 0.04921 |

| Case Flag | Allele B | AA | AB | BB | Model | p-Value | Odds Ratio |
|---|---|---|---|---|---|---|---|
| 0 | A | 892 | 283 | 34 | Dominant | 0.0772 | 1.172 |
| 1 | A | 867 | 337 | 24 | | | |

Table 52A indicates SNPs found to be in strong linkage disequilibrium with rs1057083. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 52A

Linked SNPs

| SNP | $r^2$ | Position on chr8 | SEQ ID NO |
|---|---|---|---|
| rs12676904 | 0.806 | 141567935 | 1195 |
| rs4961309 | 1.0 | 141583366 | 1196 |
| rs1057083 | — | 141587219 | 1197 |
| rs6578111 | 1.0 | 141589763 | 1198 |
| rs4246131 | 0.752 | 141595220 | 1199 |
| rs4961323 | 1.0 | 141595413 | 1200 |
| rs10216653 | 1.0 | 141596167 | 1201 |
| rs4610723 | 0.951 | 141596488 | 1202 |
| rs7388327 | 0.521 | 141597272 | 1203 |

EXAMPLE 53

For individuals with colorectal cancer, the distribution of polymorphic alleles at position 6355683 of chromosome 9 was different from those without colorectal cancer (Table 53). The recessive test for risk associated with carrying the A allele had an empirical p-value of 0.005611 based on permutation analysis, and the corresponding recessive odds ratio is 1.289 (Table 53). These data further suggest that this marker is associated with colorectal cancer risk and that the A allele at position 6355683 of chromosome 9 is associated with an increased risk of developing colorectal cancer.

TABLE 53

| rs no. | 719725 |
|---|---|
| Chromosome; Position | 9; 6355683 |
| Gene Name | |
| SEQ ID NO; Position | ; |
| Genotype; Phenotype | n = A; increased risk |
| Hardy-Weinberg | 0.50139 |

| Case Flag | Allele B | AA | AB | BB | Model | p-Value | Odds Ratio |
|---|---|---|---|---|---|---|---|
| 0 | A | 138 | 479 | 378 | Recessive | 0.005611 | 1.289 |
| 1 | A | 121 | 435 | 439 | | | |

Table 53A indicates SNPs found to be in strong linkage disequilibrium with rs719725. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 53A

Linked SNPs

| SNP | $r^2$ | Position on chr9 | SEQ ID NO |
|---|---|---|---|
| rs744567 | 0.509 | 6282602 | 1204 |
| rs17756142 | 0.553 | 6291578 | 1205 |
| rs1322166 | 0.57 | 6299862 | 1206 |
| rs17705436 | 0.553 | 6300908 | 1207 |
| rs4742179 | 0.518 | 6314376 | 1208 |
| rs10758764 | 0.511 | 6316825 | 1209 |
| rs10491836 | 0.649 | 6321421 | 1210 |
| rs16924356 | 0.615 | 6321610 | 1211 |
| rs721352 | 0.518 | 6322901 | 1212 |
| rs7850988 | 0.649 | 6325760 | 1213 |
| rs731585 | 0.546 | 6332328 | 1214 |
| rs2169282 | 0.717 | 6340235 | 1215 |
| rs16924428 | 0.624 | 6341111 | 1216 |
| rs10975552 | 0.966 | 6341834 | 1217 |

TABLE 53A-continued

Linked SNPs

| SNP | $r^2$ | Position on chr9 | SEQ ID NO |
|---|---|---|---|
| rs10975553 | 1.0 | 6342819 | 1218 |
| rs7022186 | 1.0 | 6349144 | 1219 |
| rs7851246 | 0.649 | 6352365 | 1220 |
| rs10975558 | 0.649 | 6354449 | 1221 |
| rs7875812 | 1.0 | 6354533 | 1222 |
| rs719724 | 0.84 | 6355614 | 1223 |
| rs719725 | — | 6355683 | 1224 |
| rs7860427 | 0.74 | 6375637 | 1225 |
| rs7025295 | 0.965 | 6385247 | 1226 |
| rs7850497 | 0.782 | 6385540 | 1227 |
| rs10217561 | 0.782 | 6386245 | 1228 |
| rs10815428 | 0.686 | 6390030 | 1229 |
| rs7045097 | 0.816 | 6392856 | 1230 |
| rs10758783 | 0.816 | 6397799 | 1231 |
| rs10739097 | 0.834 | 6397843 | 1232 |
| rs7865955 | 0.84 | 6398247 | 1233 |
| rs7857628 | 0.966 | 6399874 | 1234 |

EXAMPLE 54

For individuals with colorectal cancer, the distribution of polymorphic alleles at position 73642109 of chromosome 9 was different from those without colorectal cancer (Table 54). The trend test for risk associated with carrying the A allele had an empirical p-value of 0.005462 based on permutation analysis, and the corresponding Mantel-Haenszel odds ratio for trend is 1.489 (Table 54). These data further suggest that this marker is associated with colorectal cancer risk and that the A allele at position 73642109 of chromosome 9 is associated with an increased risk of developing colorectal cancer.

TABLE 54

| rs no. | 10512028 |
|---|---|
| Chromosome; Position | 9; 73642109 |
| Gene Name | |
| SEQ ID NO; Position | ; |
| Genotype; Phenotype | n = A; increased risk |
| Hardy-Weinberg | 0.28078 |

| Case Flag | Allele B | AA | AB | BB | Model | p-Value | Odds Ratio |
|---|---|---|---|---|---|---|---|
| 0 | A | 6 | 113 | 852 | Trend | 0.005462 | 1.489 |
| 1 | A | 3 | 81 | 911 | | | |

Table 54A indicates SNPs found to be in strong linkage disequilibrium with rs10512028. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 54A

Linked SNPs

| SNP | $r^2$ | Position on chr9 | SEQ ID NO |
|---|---|---|---|
| rs4288438 | 1.0 | 73606988 | 1235 |
| rs6560355 | 1.0 | 73607164 | 1236 |
| rs1585251 | 1.0 | 73607569 | 1237 |
| rs4745250 | 1.0 | 73612124 | 1238 |
| rs7044457 | 1.0 | 73613027 | 1239 |
| rs2061399 | 1.0 | 73614943 | 1240 |

TABLE 54A-continued

Linked SNPs

| SNP | $r^2$ | Position on chr9 | SEQ ID NO |
|---|---|---|---|
| rs2061398 | 1.0 | 73615076 | 1241 |
| rs2061396 | 1.0 | 73615232 | 1242 |
| rs2061395 | 1.0 | 73616781 | 1243 |
| rs10781152 | 1.0 | 73617303 | 1244 |
| rs4745254 | 1.0 | 73618675 | 1245 |
| rs2168884 | 1.0 | 73619146 | 1246 |
| rs4745255 | 1.0 | 73622095 | 1247 |
| rs4745256 | 1.0 | 73622395 | 1248 |
| rs4745257 | 1.0 | 73622439 | 1249 |
| rs4745258 | 1.0 | 73625852 | 1250 |
| rs4745259 | 1.0 | 73626601 | 1251 |
| rs4745260 | 1.0 | 73626706 | 1252 |
| rs7389572 | 1.0 | 73627824 | 1253 |
| rs10746927 | 1.0 | 73628740 | 1254 |
| rs7048840 | 1.0 | 73629704 | 1255 |
| rs4744695 | 1.0 | 73633747 | 1256 |
| rs981197 | 1.0 | 73634385 | 1257 |
| rs1458489 | 1.0 | 73635467 | 1258 |
| rs1379909 | 1.0 | 73635691 | 1259 |
| rs1379910 | 1.0 | 73635782 | 1260 |
| rs1902976 | 1.0 | 73636447 | 1261 |
| rs1902978 | 1.0 | 73636612 | 1262 |
| rs7026566 | 1.0 | 73636831 | 1263 |
| rs1379911 | 1.0 | 73638980 | 1264 |
| rs7027893 | 1.0 | 73639771 | 1265 |
| rs7039655 | 1.0 | 73639895 | 1266 |
| rs4468001 | 1.0 | 73640222 | 1267 |
| rs10512028 | — | 73642109 | 1268 |
| rs999791 | 1.0 | 73642315 | 1269 |
| rs17059425 | 1.0 | 73643177 | 1270 |

EXAMPLE 55

For individuals with colorectal cancer, the distribution of polymorphic alleles at position 79353007 of chromosome 9 was different from those without colorectal cancer (Table 55). The recessive test for risk associated with carrying the T allele had an empirical p-value of 0.016576 based on permutation analysis, and the corresponding recessive odds ratio is 1.573 (Table 55). These data further suggest that this marker is associated with colorectal cancer risk and that the T allele at position 79353007 of chromosome 9 is associated with an increased risk of developing colorectal cancer.

TABLE 55

| rs no. | 946807 |
|---|---|
| Chromosome; Position | 9; 79353007 |
| Gene Name | |
| SEQ ID NO; Position | ; |
| Genotype; Phenotype | n = T; increased risk |
| Hardy-Weinberg | 0.39477 |

| Case Flag | Allele B | AA | AB | BB | Model | p-Value | Odds Ratio |
|---|---|---|---|---|---|---|---|
| 0 | T | 0 | 76 | 895 | Recessive | 0.016576 | 1.573 |
| 1 | T | 1 | 50 | 945 | | | |

Table 55A indicates SNPs found to be in strong linkage disequilibrium with rs946807. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 55A

| SNP | $r^2$ | Position on chr9 | SEQ ID NO |
|---|---|---|---|
| rs946807 | — | 79353007 | 1271 |
| rs7040700 | 0.59 | 79353924 | 1272 |
| rs12005727 | 1.0 | 79356465 | 1273 |
| rs12347524 | 1.0 | 79356737 | 1274 |
| rs10867398 | 0.536 | 79359981 | 1275 |

Linked SNPs

EXAMPLE 56

For individuals with colorectal cancer, the distribution of polymorphic alleles at position 110115339 of chromosome 9 was different from those without colorectal cancer (Table 56). The recessive test for risk associated with carrying the A allele had an empirical p-value of 0.009423 based on permutation analysis, and the corresponding recessive odds ratio is 1.294 (Table 56). These data further suggest that this marker is associated with colorectal cancer risk and that the A allele at position 110115339 of chromosome 9 is associated with an increased risk of developing colorectal cancer.

TABLE 56

| rs no. | 10512404 |
|---|---|
| Chromosome; Position | 9; 110115339 |
| Gene Name | |
| SEQ ID NO; Position | ; |
| Genotype; Phenotype | n = A; increased risk |
| Hardy-Weinberg | 0.04658 |

| Case Flag | Allele B | AA | AB | BB | Model | p-Value | Odds Ratio |
|---|---|---|---|---|---|---|---|
| 0 | A | 44 | 278 | 649 | Recessive | 0.009423 | 1.294 |
| 1 | A | 37 | 239 | 720 | | | |

Table 56A indicates SNPs found to be in strong linkage disequilibrium with rs10512404. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 56A

Linked SNPs

| SNP | $r^2$ | Position on chr9 | SEQ ID NO |
|---|---|---|---|
| rs10512404 | — | 110115339 | 1276 |
| rs10980301 | 1.0 | 110130428 | 1277 |

EXAMPLE 57

For individuals with colorectal cancer, the distribution of polymorphic alleles at position 4453422 of chromosome 11, found within the OR52K3P gene, was different from those without colorectal cancer (Table 57). The dominant test for risk associated with carrying the T allele had an empirical p-value based on permutation analysis of 0.002811, and the corresponding dominant odds ratio is 1.290 (Table 57). These data further suggest that this marker, located within the OR52K3P gene, is associated with colorectal cancer risk and that the T allele at position 4453422 of chromosome 11 is associated with an increased risk of developing colorectal cancer.

TABLE 57

| rs no. | 2278170 |
|---|---|
| Chromosome; Position | 11; 4453422 |
| Gene Name | OR52K3P |
| SEQ ID NO; Position | 1779; 808 |
| Genotype; Phenotype | n = T; increased risk |
| Hardy-Weinberg | 0.05835 |

| Case Flag | Allele B | AA | AB | BB | Model | p-Value | Odds Ratio |
|---|---|---|---|---|---|---|---|
| 0 | T | 570 | 431 | 107 | Dominant | 0.002811 | 1.290 |
| 1 | T | 497 | 497 | 108 | | | |

Table 57A indicates SNPs found to be in strong linkage disequilibrium with rs2278170. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 57A

Linked SNPs

| SNP | $r^2$ | Position on chr11 | SEQ ID NO |
|---|---|---|---|
| rs167948 | 0.593 | 4430296 | 1278 |
| rs10836079 | 0.835 | 4430392 | 1279 |
| rs191761 | 0.573 | 4430569 | 1280 |
| rs7395324 | 1.0 | 4434860 | 1281 |
| rs11032345 | 1.0 | 4440254 | 1282 |
| rs10836102 | 1.0 | 4442501 | 1283 |
| rs11032351 | 1.0 | 4443277 | 1284 |
| rs11032354 | 0.928 | 4443753 | 1285 |
| rs11032359 | 0.925 | 4444427 | 1286 |
| rs11032361 | 0.929 | 4444806 | 1287 |
| rs10768026 | 1.0 | 4446686 | 1288 |
| rs331502 | 1.0 | 4448408 | 1289 |
| rs11032378 | 0.929 | 4449042 | 1290 |
| rs11032381 | 0.929 | 4449105 | 1291 |
| rs890416 | 0.929 | 4449910 | 1292 |
| rs890417 | 0.927 | 4450407 | 1293 |
| rs890418 | 0.929 | 4450528 | 1294 |
| rs331503 | 1.0 | 4451604 | 1295 |
| rs9633905 | 1.0 | 4453189 | 1296 |
| rs2278170 | — | 4453422 | 1297 |
| rs2278171 | 1.0 | 4453492 | 1298 |
| rs2278172 | 0.964 | 4453537 | 1299 |
| rs2278173 | 1.0 | 4453673 | 1300 |
| rs11032407 | 1.0 | 4454017 | 1301 |
| rs9633900 | 1.0 | 4454894 | 1302 |
| rs2641405 | 0.658 | 4532655 | 1303 |
| rs11032827 | 0.577 | 4543829 | 1304 |

EXAMPLE 58

For individuals with colorectal cancer, the distribution of polymorphic alleles at position 5766249 of chromosome 11, found within the OR52N1 gene, was different from those without colorectal cancer (Table 58). The dominant test for risk associated with carrying the C allele had an empirical p-value based on permutation analysis of 0.002453, and the corresponding dominant odds ratio is 1.584 (Table 58). These data further suggest that this marker, located within the OR52N1 gene, is associated with colorectal cancer risk and that the C allele at position 5766249 of chromosome 11 is associated with an increased risk of developing colorectal cancer.

TABLE 58

| rs no. | 10769224 |
|---|---|
| Chromosome; Position | 11; 5766249 |
| Gene Name | OR52N1 |
| SEQ ID NO; Position | 1780; 374 |
| Genotype; Phenotype | n = C; increased risk |
| Hardy-Weinberg | 0.07909 |

| Case Flag | Allele B | AA | AB | BB | Model | p-Value | Odds Ratio |
|---|---|---|---|---|---|---|---|
| 0 | C | 117 | 453 | 559 | Dominant | 0.002453 | 1.584 |
| 1 | C | 77 | 502 | 553 | | | |

Table 58A indicates SNPs found to be in strong linkage disequilibrium with rs10769224. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 58A

Linked SNPs

| SNP | r² | Position on chr11 | SEQ ID NO |
|---|---|---|---|
| rs7948009 | 0.819 | 5766124 | 1305 |
| rs10769224 | — | 5766249 | 1306 |
| rs10742787 | 1.0 | 5766322 | 1307 |
| rs7924824 | 1.0 | 5768065 | 1308 |
| rs10838648 | 0.698 | 5772861 | 1309 |
| rs10769232 | 1.0 | 5774897 | 1310 |
| rs7949986 | 1.0 | 5775192 | 1311 |
| rs1377512 | 1.0 | 5776193 | 1312 |
| rs7940926 | 1.0 | 5778275 | 1313 |
| rs10769235 | 1.0 | 5779169 | 1314 |
| rs10769236 | 1.0 | 5779183 | 1315 |
| rs4758099 | 1.0 | 5779725 | 1316 |
| rs4758100 | 0.804 | 5779774 | 1317 |
| rs4758101 | 1.0 | 5779871 | 1318 |
| rs7484069 | 0.826 | 5780048 | 1319 |
| rs11039085 | 0.524 | 5780227 | 1320 |
| rs7937133 | 1.0 | 5781044 | 1321 |
| rs1453419 | 1.0 | 5781459 | 1322 |
| rs1453418 | 1.0 | 5781526 | 1323 |
| rs1453417 | 0.688 | 5781557 | 1324 |
| rs11039096 | 0.845 | 5781753 | 1325 |
| rs10742793 | 0.672 | 5782739 | 1326 |
| rs11039102 | 0.704 | 5783829 | 1327 |
| rs12279684 | 0.524 | 5783893 | 1328 |
| rs11607346 | 0.634 | 5784028 | 1329 |
| rs6578689 | 0.71 | 5784528 | 1330 |
| rs1453415 | 0.67 | 5785595 | 1331 |
| rs1840175 | 0.67 | 5786072 | 1332 |
| rs4372479 | 0.655 | 5792979 | 1333 |
| rs10734554 | 0.861 | 5799485 | 1334 |
| rs7938541 | 1.0 | 5800361 | 1335 |
| rs4758444 | 0.524 | 5802527 | 1336 |
| rs1979197 | 0.51 | 5802898 | 1337 |

EXAMPLE 59

For individuals with colorectal cancer, the distribution of polymorphic alleles at position 43156746 of chromosome 11 was different from those without colorectal cancer (Table 59). The recessive test for risk associated with carrying the T allele had an empirical p-value of 0.062 based on permutation analysis, and the corresponding recessive odds ratio is 1.698 (Table 59). These data further suggest that this marker is associated with colorectal cancer risk and that the T allele at position 43156746 of chromosome 11 is associated with an increased risk of developing colorectal cancer.

TABLE 59

| rs no. | 890248 |
|---|---|
| Chromosome; Position | 11; 43156746 |
| Gene Name | |
| SEQ ID NO; Position | ; |
| Genotype; Phenotype | n = T; increased risk |
| Hardy-Weinberg | 1 |

| Case Flag | Allele B | AA | AB | BB | Model | p-Value | Odds Ratio |
|---|---|---|---|---|---|---|---|
| 0 | T | 720 | 252 | 22 | Recessive | 0.062 | 1.698 |
| 1 | T | 699 | 264 | 37 | | | |

Table 59A indicates SNPs found to be in strong linkage disequilibrium with rs890248. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 59A

Linked SNPs

| SNP | r² | Position on chr11 | SEQ ID NO |
|---|---|---|---|
| rs11601828 | 0.646 | 43124098 | 1338 |
| rs11037302 | 0.704 | 43145953 | 1339 |
| rs7940185 | 0.669 | 43149399 | 1340 |
| rs6485403 | 0.715 | 43151108 | 1341 |
| rs2114089 | 0.688 | 43153254 | 1342 |
| rs7931762 | 1.0 | 43154329 | 1343 |
| rs1559763 | 1.0 | 43154718 | 1344 |
| rs1025168 | 1.0 | 43155303 | 1345 |
| rs1353463 | 1.0 | 43156052 | 1346 |
| rs890249 | 0.715 | 43156514 | 1347 |
| rs890248 | — | 43156746 | 1348 |
| rs890246 | 0.857 | 43156937 | 1349 |
| rs7935140 | 0.715 | 43158142 | 1350 |
| rs7938445 | 1.0 | 43158508 | 1351 |
| rs977439 | 1.0 | 43159402 | 1352 |
| rs977438 | 1.0 | 43159607 | 1353 |
| rs7943295 | 1.0 | 43160243 | 1354 |
| rs2068405 | 1.0 | 43160762 | 1355 |
| rs7933421 | 0.715 | 43160895 | 1356 |
| rs959648 | 1.0 | 43160975 | 1357 |
| rs959647 | 0.715 | 43161066 | 1358 |
| rs10838055 | 0.715 | 43161471 | 1359 |
| rs10838056 | 1.0 | 43161777 | 1360 |
| rs7129867 | 1.0 | 43161927 | 1361 |
| rs7950242 | 1.0 | 43167395 | 1362 |
| rs7950144 | 0.715 | 43167433 | 1363 |
| rs1318986 | 1.0 | 43169005 | 1364 |
| rs1025166 | 1.0 | 43169462 | 1365 |
| rs1425857 | 1.0 | 43170570 | 1366 |
| rs10768938 | 1.0 | 43171231 | 1367 |

EXAMPLE 60

For individuals with colorectal cancer, the distribution of polymorphic alleles at position 73972614 of chromosome 11 was different from those without colorectal cancer (Table 60). The trend test for risk associated with carrying the A allele had an empirical p-value of 0.007216 based on permutation analysis, and the corresponding Mantel-Haenszel odds ratio for trend is 1.169 (Table 60). These data further suggest that this marker is associated with colorectal cancer risk and that the A allele at position 73972614 of chromosome 11 is associated with an increased risk of developing colorectal cancer.

TABLE 60

| rs no. | 11236164 |
|---|---|
| Chromosome; Position | 11; 73972614 |
| Gene Name | |
| SEQ ID NO; Position | ; |
| Genotype; Phenotype | n = A; increased risk |
| Hardy-Weinberg | 0.45469 |

| Case Flag | Allele B | AA | AB | BB | Model | p-Value | Odds Ratio |
|---|---|---|---|---|---|---|---|
| 0 | A | 305 | 618 | 286 | Trend | 0.007216 | 1.169 |
| 1 | A | 267 | 621 | 342 | | | |

Table 60A indicates SNPs found to be in strong linkage disequilibrium with rs11236164. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 60A

Linked SNPs

| SNP | $r^2$ | Position on chr11 | SEQ ID NO |
|---|---|---|---|
| rs10899009 | 1.0 | 73953815 | 1368 |
| rs10793092 | 1.0 | 73956355 | 1369 |
| rs10793093 | 0.832 | 73968600 | 1370 |
| rs11236164 | — | 73972614 | 1371 |
| rs7940880 | 0.966 | 73995062 | 1376 |
| rs10219203 | 0.96 | 74002571 | 1377 |
| rs10793094 | 1.0 | 74013473 | 1383 |
| rs2155935 | 0.966 | 74017225 | 1385 |
| rs2298792 | 0.966 | 74017844 | 1386 |
| rs11236178 | 0.966 | 74018984 | 1387 |
| rs3824999 | 0.966 | 74023198 | 1388 |
| rs10899024 | 0.705 | 74036330 | 1393 |
| rs7932922 | 0.68 | 74037678 | 1396 |
| rs1944933 | 0.923 | 74039262 | 1397 |
| rs11236185 | 0.928 | 74040179 | 1398 |
| rs4145954 | 0.669 | 74040814 | 1399 |
| rs11236187 | 0.966 | 74042214 | 1400 |
| rs11236188 | 0.966 | 74042378 | 1401 |
| rs6421715 | 0.966 | 74052598 | 1402 |
| rs11236203 | 0.966 | 74055648 | 1403 |
| rs11825804 | 0.964 | 74056519 | 1404 |
| rs6592590 | 0.649 | 74058677 | 1405 |
| rs11822234 | 0.631 | 74062794 | 1406 |
| rs11602237 | 0.604 | 74063339 | 1407 |
| rs7104802 | 0.572 | 74064448 | 1408 |
| rs17244949 | 0.632 | 74067429 | 1410 |

EXAMPLE 61

For individuals with colorectal cancer, the distribution of polymorphic alleles at position 73982157 of chromosome 11, found within the POLD3 gene, was different from those without colorectal cancer (Table 61). The trend test for risk associated with carrying the C allele had an empirical p-value of 0.038785 based on permutation analysis, and the corresponding Mantel-Haenszel odds ratio for trend is 1.177 (Table 61). These data further suggest that this marker, located within the POLD3 gene, is associated with colorectal cancer risk and that the C allele at position 73982157 of chromosome 11 is associated with an increased risk of developing colorectal cancer.

TABLE 61

| rs no. | 7939226 |
|---|---|
| Chromosome; Position | 11; 73982157 |
| Gene Name | POLD3 |
| SEQ ID NO; Position | 1781; 881 |
| Genotype; Phenotype | n = C; increased risk |
| Hardy-Weinberg | 0.59483 |

| Case Flag | Allele B | AA | AB | BB | Model | p-Value | Odds Ratio |
|---|---|---|---|---|---|---|---|
| 0 | C | 34 | 322 | 853 | Trend | 0.038785 | 1.177 |
| 1 | C | 25 | 294 | 911 | | | |

Table 61A indicates SNPs found to be in strong linkage disequilibrium with rs7939226. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 61A

Linked SNPs

| SNP | $r^2$ | Position on chr11 | SEQ ID NO |
|---|---|---|---|
| rs7944514 | 0.516 | 73978840 | 1372 |
| rs7939226 | — | 73982157 | 1373 |
| rs10899013 | 0.543 | 73987190 | 1374 |
| rs6592573 | 0.543 | 73990610 | 1375 |
| rs4944051 | 0.673 | 74002983 | 1378 |
| rs4145953 | 0.66 | 74009527 | 1381 |
| rs1433970 | 0.673 | 74016841 | 1384 |
| rs3741127 | 1.0 | 74024581 | 1389 |
| rs1051058 | 0.673 | 74029849 | 1390 |
| rs7123887 | 0.636 | 74033737 | 1391 |
| rs4944922 | 0.635 | 74034353 | 1392 |
| rs7106219 | 0.636 | 74036714 | 1394 |
| rs4944925 | 0.636 | 74037177 | 1395 |
| rs12789086 | 0.747 | 74067075 | 1409 |
| rs11236208 | 0.707 | 74067969 | 1411 |
| rs12282262 | 0.589 | 74071586 | 1412 |

EXAMPLE 62

For individuals with colorectal cancer, the distribution of polymorphic alleles at position 74002983 of chromosome 11, found within the POLD3 gene, was different from those without colorectal cancer (Table 62). The trend test for risk associated with carrying the T allele had an empirical p-value of 0.016198 based on permutation analysis, and the corresponding Mantel-Haenszel odds ratio for trend is 1.176 (Table 62). These data further suggest that this marker, located within the POLD3 gene, is associated with colorectal cancer risk and that the T allele at position 74002983 of chromosome 11 is associated with an increased risk of developing colorectal cancer.

TABLE 62

| rs no. | 4944051 |
|---|---|
| Chromosome; Position | 11; 74002983 |
| Gene Name | POLD3 |
| SEQ ID NO; Position | 1781; 21707 |
| Genotype; Phenotype | n = T; increased risk |
| Hardy-Weinberg | 0.12046 |

TABLE 62-continued

| Case Flag | Allele B | AA | AB | BB | Model | p-Value | Odds Ratio |
|---|---|---|---|---|---|---|---|
| 0 | T | 72 | 406 | 731 | Trend | 0.016198 | 1.176 |
| 1 | T | 53 | 382 | 795 | | | |

Table 62A indicates SNPs found to be in strong linkage disequilibrium with rs4944051. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 62A

Linked SNPs

| SNP | $r^2$ | Position on chr11 | SEQ ID NO |
|---|---|---|---|
| rs7939226 | 0.673 | 73982157 | 1373 |
| rs4944051 | — | 74002983 | 1378 |
| rs7943085 | 0.582 | 74007856 | 1379 |
| rs10501417 | 0.582 | 74008628 | 1380 |
| rs4145953 | 1.0 | 74009527 | 1381 |
| rs11236173 | 0.582 | 74009910 | 1382 |
| rs1433970 | 1.0 | 74016841 | 1384 |
| rs3741127 | 0.659 | 74024581 | 1389 |
| rs1051058 | 1.0 | 74029849 | 1390 |
| rs7123887 | 0.945 | 74033737 | 1391 |
| rs4944922 | 0.945 | 74034353 | 1392 |
| rs7106219 | 0.945 | 74036714 | 1394 |
| rs4944925 | 0.945 | 74037177 | 1395 |

EXAMPLE 63

For individuals with colorectal cancer, the distribution of polymorphic alleles at position 83565887 of chromosome 11, found within the DLG2 gene, was different from those without colorectal cancer (Table 63). The recessive test for risk associated with carrying the T allele had an empirical p-value of 0.0749 based on permutation analysis, and the corresponding recessive odds ratio is 1.223 (Table 63). These data further suggest that this marker, located within the DLG2 gene, is associated with colorectal cancer risk and that the T allele at position 83565887 of chromosome 11 is associated with an increased risk of developing colorectal cancer.

TABLE 63

| rs no. | 1454027 |
|---|---|
| Chromosome; Position | 11; 83565887 |
| Gene Name | DLG2 |
| SEQ ID NO; Position | 1782; 746200 |
| Genotype; Phenotype | n = T; increased risk |
| Hardy-Weinberg | 0.15576 |

| Case Flag | Allele B | AA | AB | BB | Model | p-Value | Odds Ratio |
|---|---|---|---|---|---|---|---|
| 0 | T | 8 | 210 | 771 | Recessive | 0.0749 | 1.223 |
| 1 | T | 13 | 174 | 809 | | | |

Table 63A indicates SNPs found to be in strong linkage disequilibrium with rs1454027. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 63A

Linked SNPs

| SNP | $r^2$ | Position on chr11 | SEQ ID NO |
|---|---|---|---|
| rs790367 | 0.536 | 83325571 | 1413 |
| rs1599914 | 0.536 | 83326348 | 1414 |
| rs790372 | 0.536 | 83331489 | 1415 |
| rs1471687 | 0.608 | 83333982 | 1416 |
| rs790351 | 0.536 | 83338726 | 1417 |
| rs2449592 | 0.536 | 83346857 | 1418 |
| rs2449594 | 0.536 | 83359180 | 1419 |
| rs2514171 | 0.536 | 83378990 | 1420 |
| rs2449575 | 0.536 | 83383578 | 1421 |
| rs1817515 | 0.536 | 83385447 | 1422 |
| rs7933909 | 0.535 | 83386501 | 1423 |
| rs1483387 | 0.536 | 83387013 | 1424 |
| rs1586143 | 0.536 | 83389630 | 1425 |
| rs1118277 | 0.509 | 83389983 | 1426 |
| rs1304480 | 0.536 | 83390829 | 1427 |
| rs2170707 | 0.536 | 83400665 | 1428 |
| rs1483388 | 0.536 | 83402660 | 1429 |
| rs2514167 | 0.536 | 83403491 | 1430 |
| rs2514166 | 0.536 | 83403720 | 1431 |
| rs10751101 | 0.536 | 83404929 | 1432 |
| rs2853026 | 0.536 | 83418135 | 1433 |
| rs1601094 | 0.536 | 83420693 | 1434 |
| rs1160818 | 0.536 | 83430317 | 1435 |
| rs7114261 | 0.774 | 83504794 | 1436 |
| rs7108582 | 0.774 | 83508907 | 1437 |
| rs1945828 | 0.774 | 83513418 | 1438 |
| rs1945824 | 0.749 | 83523059 | 1439 |
| rs10501555 | 0.774 | 83525615 | 1440 |
| rs1014066 | 0.774 | 83527163 | 1441 |
| rs2000961 | 0.773 | 83532440 | 1442 |
| rs1584854 | 0.536 | 83540697 | 1443 |
| rs1598073 | 0.536 | 83542042 | 1444 |
| rs1454019 | 0.773 | 83548041 | 1445 |
| rs1869472 | 1.0 | 83555723 | 1446 |
| rs1454027 | — | 83565887 | 1447 |
| rs970226 | 1.0 | 83569470 | 1448 |
| rs1670685 | 0.536 | 83570172 | 1449 |
| rs7943267 | 0.891 | 83572107 | 1450 |
| rs988322 | 1.0 | 83574800 | 1451 |
| rs1377746 | 1.0 | 83576676 | 1452 |
| rs7941004 | 0.881 | 83594342 | 1453 |
| rs10751106 | 0.73 | 83597820 | 1454 |
| rs7394840 | 1.0 | 83598063 | 1455 |
| rs4944472 | 0.785 | 83599752 | 1456 |
| rs10751109 | 0.774 | 83601427 | 1457 |

EXAMPLE 64

For individuals with colorectal cancer, the distribution of polymorphic alleles at position 115738853 of chromosome 11 was different from those without colorectal cancer (Table 64). The trend test for risk associated with carrying the A allele had an empirical p-value of 0.006275 based on permutation analysis, and the corresponding Mantel-Haenszel odds ratio for trend is 1.202 (Table 64). These data further suggest that this marker is associated with colorectal cancer risk and that the A allele at position 115738853 of chromosome 11 is associated with an increased risk of developing colorectal cancer.

TABLE 64

| rs no. | 572619 |
|---|---|
| Chromosome; Position | 11; 115738853 |
| Gene Name | |
| SEQ ID NO; Position | ; |
| Genotype; Phenotype | n = A; increased risk |
| Hardy-Weinberg | 0.94522 |

TABLE 64-continued

| Case Flag | Allele B | AA | AB | BB | Model | p-Value | Odds Ratio |
|---|---|---|---|---|---|---|---|
| 0 | A | 135 | 452 | 384 | Trend | 0.006275 | 1.202 |
| 1 | A | 110 | 437 | 449 | | | |

Table 64A indicates SNPs found to be in strong linkage disequilibrium with rs572619. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 64A

Linked SNPs

| SNP | $r^2$ | Position on chr11 | SEQ ID NO |
|---|---|---|---|
| rs513935 | 0.507 | 115737050 | 1458 |
| rs572619 | — | 115738853 | 1459 |
| rs574529 | 1.0 | 115739067 | 1460 |
| rs526151 | 0.575 | 115741985 | 1461 |
| rs571139 | 0.928 | 115742227 | 1462 |
| rs488435 | 0.575 | 115742992 | 1463 |
| rs491111 | 0.927 | 115743244 | 1464 |
| rs567559 | 0.648 | 115744952 | 1465 |
| rs541874 | 0.615 | 115745463 | 1466 |
| rs11215905 | 0.544 | 115747903 | 1467 |

EXAMPLE 65

For individuals with colorectal cancer, the distribution of polymorphic alleles at position 9814118 of chromosome 12 was different from those without colorectal cancer (Table 65). The dominant test for risk associated with carrying the A allele had an empirical p-value based on permutation analysis of 0.006667, and the corresponding dominant odds ratio is 1.277 (Table 65). These data further suggest that this marker is associated with colorectal cancer risk and that the A allele at position 9814118 of chromosome 12 is associated with an increased risk of developing colorectal cancer.

TABLE 65

| rs no. | 724667 |
|---|---|
| Chromosome; Position | 12; 9814118 |
| Gene Name | |
| SEQ ID NO; Position | ; |
| Genotype; Phenotype | n = A; increased risk |
| Hardy-Weinberg | 0.09590 |

| Case Flag | Allele B | AA | AB | BB | Model | p-Value | Odds Ratio |
|---|---|---|---|---|---|---|---|
| 0 | A | 563 | 359 | 75 | Dominant | 0.006667 | 1.277 |
| 1 | A | 503 | 424 | 71 | | | |

Table 65A indicates SNPs found to be in strong linkage disequilibrium with rs724667. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 65A

Linked SNPs

| SNP | $r^2$ | Position on chr12 | SEQ ID NO |
|---|---|---|---|
| rs3176789 | 0.959 | 9803997 | 1468 |
| rs2071647 | 1.0 | 9805272 | 1469 |
| rs3136559 | 1.0 | 9807907 | 1470 |
| rs3176776 | 0.64 | 9808088 | 1471 |
| rs3176775 | 0.64 | 9808349 | 1472 |
| rs3176773 | 0.597 | 9809369 | 1473 |
| rs12422685 | 0.64 | 9811239 | 1474 |
| rs724668 | 1.0 | 9814096 | 1475 |
| rs724667 | — | 9814118 | 1476 |
| rs724666 | 1.0 | 9814380 | 1477 |
| rs10772132 | 1.0 | 9816179 | 1478 |
| rs1029992 | 1.0 | 9817025 | 1479 |
| rs1029991 | 1.0 | 9817331 | 1480 |
| rs1029990 | 1.0 | 9817664 | 1481 |
| rs10844749 | 1.0 | 9817891 | 1482 |
| rs1540356 | 1.0 | 9818051 | 1483 |
| rs12582052 | 1.0 | 9818837 | 1484 |
| rs1861090 | 0.921 | 9820946 | 1485 |

EXAMPLE 66

For individuals with colorectal cancer, the distribution of polymorphic alleles at position 31141128 of chromosome 12, found within the DDX11 gene, was different from those without colorectal cancer (Table 66). The trend test for risk associated with carrying the G allele had an empirical p-value of 0.025417 based on permutation analysis, and the corresponding Mantel-Haenszel odds ratio for trend is 1.139 (Table 66). These data further suggest that this marker, located within the DDX11 gene, is associated with colorectal cancer risk and that the G allele at position 31141128 of chromosome 12 is associated with an increased risk of developing colorectal cancer.

TABLE 66

| rs no. | 2075322 |
|---|---|
| Chromosome; Position | 12; 31141128 |
| Gene Name | DDX11 |
| SEQ ID NO; Position | 1783; 23052 |
| Genotype; Phenotype | n = G; increased risk |
| Hardy-Weinberg | 0.48386 |

| Case Flag | Allele B | AA | AB | BB | Model | p-Value | Odds Ratio |
|---|---|---|---|---|---|---|---|
| 0 | G | 378 | 582 | 243 | Trend | 0.025417 | 1.139 |
| 1 | G | 336 | 617 | 277 | | | |

Table 66A indicates SNPs found to be in strong linkage disequilibrium with rs2075322. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 66A

Linked SNPs

| SNP | $r^2$ | Position on chr12 | SEQ ID NO |
|---|---|---|---|
| rs2075322 | — | 31141128 | 1488 |

EXAMPLE 67

For individuals with colorectal cancer, the distribution of polymorphic alleles at position 31157554 of chromosome 12 was different from those without colorectal cancer (Table 67). The trend test for risk associated with carrying the A allele had an empirical p-value of 0.027702 based on permutation analysis, and the corresponding Mantel-Haenszel odds ratio for trend is 1.146 (Table 67). These data further suggest that this marker is associated with colorectal cancer risk and that the A allele at position 31157554 of chromosome 12 is associated with an increased risk of developing colorectal cancer.

TABLE 67

| rs no. | 4931434 |
|---|---|
| Chromosome; Position | 12; 31157554 |
| Gene Name | |
| SEQ ID NO; Position | ; |
| Genotype; Phenotype | n = A; increased risk |
| Hardy-Weinberg | 0.89691 |

| Case Flag | Allele B | AA | AB | BB | Model | p-Value | Odds Ratio |
|---|---|---|---|---|---|---|---|
| 0 | A | 538 | 539 | 132 | Trend | 0.027702 | 1.146 |
| 1 | A | 496 | 577 | 157 | | | |

Table 67A indicates SNPs found to be in strong linkage disequilibrium with rs4931434. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 67A

| Linked SNPs | | | |
|---|---|---|---|
| SNP | $r^2$ | Position on chr12 | SEQ ID NO |
| rs11051239 | 0.534 | 31132974 | 1486 |
| rs1808348 | 0.515 | 31136113 | 1487 |
| rs4931432 | 0.588 | 31144153 | 1489 |
| rs11219 | 0.588 | 31148962 | 1490 |
| rs1974752 | 0.588 | 31149995 | 1491 |
| rs2111770 | 0.581 | 31152638 | 1492 |
| rs2005900 | 0.588 | 31152965 | 1493 |
| rs1053552 | 0.588 | 31156037 | 1494 |
| rs4931434 | — | 31157554 | 1495 |
| rs4244856 | 0.581 | 31157580 | 1496 |

EXAMPLE 68

For individuals with colorectal cancer, the distribution of polymorphic alleles at position 21875373 of chromosome 13 was different from those without colorectal cancer (Table 68). The dominant test for risk associated with carrying the G allele had an empirical p-value based on permutation analysis of 0.01544, and the corresponding dominant odds ratio is 1.618 (Table 68). These data further suggest that this marker is associated with colorectal cancer risk and that the G allele at position 21875373 of chromosome 13 is associated with an increased risk of developing colorectal cancer.

TABLE 68

| rs no. | 10507308 |
|---|---|
| Chromosome; Position | 13; 21875373 |
| Gene Name | |
| SEQ ID NO; Position | ; |
| Genotype; Phenotype | n = G; increased risk |
| Hardy-Weinberg | 0.41148 |

| Case Flag | Allele B | AA | AB | BB | Model | p-Value | Odds Ratio |
|---|---|---|---|---|---|---|---|
| 0 | G | 954 | 44 | 1 | Dominant | 0.01544 | 1.618 |
| 1 | G | 930 | 70 | 1 | | | |

Table 68A indicates SNPs found to be in strong linkage disequilibrium with rs10507308. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 68A

| Linked SNPs | | | |
|---|---|---|---|
| SNP | $r^2$ | Position on chr13 | SEQ ID NO |
| rs9506845 | 0.66 | 21846344 | 1497 |
| rs2038713 | 1.0 | 21860220 | 1498 |
| rs692783 | 0.59 | 21868669 | 1499 |
| rs573671 | 0.589 | 21868693 | 1500 |
| rs1886088 | 0.59 | 21870958 | 1501 |
| rs9316962 | 0.59 | 21873258 | 1502 |
| rs10507308 | — | 21875373 | 1503 |

EXAMPLE 69

For individuals with colorectal cancer, the distribution of polymorphic alleles at position 32659011 of chromosome 13, found within the STARD13 gene, was different from those without colorectal cancer (Table 69). The trend test for risk associated with carrying the A allele had an empirical p-value of 0.005337 based on permutation analysis, and the corresponding Mantel-Haenszel odds ratio for trend is 1.229 (Table 69). These data further suggest that this marker, located within the STARD13 gene, is associated with colorectal cancer risk and that the A allele at position 32659011 of chromosome 13 is associated with an increased risk of developing colorectal cancer.

TABLE 69

| rs no. | 797206 |
|---|---|
| Chromosome; Position | 13; 32659011 |
| Gene Name | STARD13 |
| SEQ ID NO; Position | 1784; 98882 |
| Genotype; Phenotype | n = A; increased risk |
| Hardy-Weinberg | 0.75076 |

| Case Flag | Allele B | AA | AB | BB | Model | p-Value | Odds Ratio |
|---|---|---|---|---|---|---|---|
| 0 | A | 74 | 396 | 500 | Trend | 0.005337 | 1.229 |
| 1 | A | 58 | 365 | 573 | | | |

Table 69A indicates SNPs found to be in strong linkage disequilibrium with rs797206. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 69A

| SNP | $r^2$ | Position on chr13 | SEQ ID NO |
|---|---|---|---|
| rs797227 | 0.68 | 32643593 | 1504 |
| rs797222 | 0.68 | 32647970 | 1505 |
| rs797211 | 0.636 | 32655052 | 1506 |
| rs797208 | 0.951 | 32658737 | 1507 |
| rs797206 | — | 32659011 | 1508 |
| rs797201 | 0.904 | 32665137 | 1509 |

EXAMPLE 70

For individuals with colorectal cancer, the distribution of polymorphic alleles at position 45440577 of chromosome 13, found within the KIAA0853 gene, was different from those without colorectal cancer (Table 70). The dominant test for risk associated with carrying the G allele had an empirical p-value based on permutation analysis of 0.023626, and the corresponding dominant odds ratio is 1.210 (Table 70). These data further suggest that this marker, located within the KIAA0853 gene, is associated with colorectal cancer risk and that the G allele at position 45440577 of chromosome 13 is associated with an increased risk of developing colorectal cancer.

TABLE 70

| | |
|---|---|
| rs no. | 4941537 |
| Chromosome; Position | 13; 45440577 |
| Gene Name | KIAA0853 |
| SEQ ID NO; Position | 1785; 84319 |
| Genotype; Phenotype | n = G; increased risk |
| Hardy-Weinberg | 0.11382 |

| Case Flag | Allele B | AA | AB | BB | Model | p-Value | Odds Ratio |
|---|---|---|---|---|---|---|---|
| 0 | G | 473 | 545 | 190 | Dominant | 0.023626 | 1.210 |
| 1 | G | 427 | 605 | 198 | | | |

Table 70A indicates SNPs found to be in strong linkage disequilibrium with rs4941537. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 70A

Linked SNPs

| SNP | $r^2$ | Position on chr13 | SEQ ID NO |
|---|---|---|---|
| rs7325308 | 1.0 | 45412663 | 1510 |
| rs2075427 | 1.0 | 45413606 | 1511 |
| rs1080107 | 0.733 | 45414960 | 1512 |
| rs6561274 | 1.0 | 45416097 | 1513 |
| rs9534258 | 1.0 | 45418874 | 1514 |
| rs4460970 | 1.0 | 45438294 | 1515 |
| rs4941537 | — | 45440577 | 1516 |
| rs9534265 | 1.0 | 45445023 | 1517 |
| rs4942460 | 1.0 | 45448444 | 1518 |
| rs9316177 | 0.962 | 45459812 | 1519 |
| rs9534272 | 1.0 | 45464824 | 1520 |
| rs4941538 | 1.0 | 45484610 | 1521 |
| rs1409436 | 0.926 | 45512651 | 1522 |
| rs3783200 | 0.744 | 45514463 | 1523 |
| rs1087 | 0.636 | 45525440 | 1524 |
| rs9534304 | 0.568 | 45538603 | 1525 |
| rs9526136 | 0.642 | 45539148 | 1526 |
| rs9316179 | 0.578 | 45539467 | 1527 |
| rs9316180 | 0.578 | 45539686 | 1528 |
| rs9562635 | 0.591 | 45540993 | 1530 |
| rs7988836 | 0.655 | 45541374 | 1531 |
| rs7993537 | 0.578 | 45541562 | 1532 |
| rs9534307 | 0.578 | 45542131 | 1533 |
| rs9526140 | 0.578 | 45542153 | 1534 |
| rs9316181 | 0.578 | 45543741 | 1535 |
| rs1409434 | 0.578 | 45544445 | 1536 |
| rs3742264 | 0.601 | 45546095 | 1537 |
| rs9567613 | 0.578 | 45547399 | 1538 |
| rs11618062 | 0.578 | 45547569 | 1539 |
| rs9534312 | 0.578 | 45548220 | 1540 |
| rs9567615 | 0.607 | 45549081 | 1541 |
| rs9567618 | 0.578 | 45549309 | 1542 |
| rs1326398 | 0.523 | 45550691 | 1543 |
| rs723391 | 0.555 | 45553450 | 1544 |
| rs9534322 | 0.509 | 45568003 | 1545 |
| rs1952187 | 0.524 | 45572910 | 1546 |

EXAMPLE 71

For individuals with colorectal cancer, the distribution of polymorphic alleles at position 45525440 of chromosome 13, found within the KIAA0853 gene, was different from those without colorectal cancer (Table 71). The trend test for risk associated with carrying the T allele had an empirical p-value of 0.00737 based on permutation analysis, and the corresponding Mantel-Haenszel odds ratio for trend is 1.181 (Table 71). These data further suggest that this marker, located within the KIAA0853 gene, is associated with colorectal cancer risk and that the T allele at position 45525440 of chromosome 13 is associated with an increased risk of developing colorectal cancer.

TABLE 71

| | |
|---|---|
| rs no. | 1087 |
| Chromosome; Position | 13; 45525440 |
| Gene Name | KIAA0853 |
| SEQ ID NO; Position | 1785; |
| Genotype; Phenotype | n = T; increased risk |
| Hardy-Weinberg | 0.42878 |

| Case Flag | Allele B | AA | AB | BB | Model | p-Value | Odds Ratio |
|---|---|---|---|---|---|---|---|
| 0 | T | 563 | 515 | 131 | Trend | 0.00737 | 1.181 |
| 1 | T | 507 | 564 | 158 | | | |

Table 71A indicates SNPs found to be in strong linkage disequilibrium with rs1087. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 71A

Linked SNPs

| SNP | $r^2$ | Position on chr13 | SEQ ID NO |
|---|---|---|---|
| rs7325308 | 0.636 | 45412663 | 1510 |
| rs2075427 | 0.636 | 45413606 | 1511 |

TABLE 71A-continued

Linked SNPs

| SNP | $r^2$ | Position on chr13 | SEQ ID NO |
|---|---|---|---|
| rs6561274 | 0.636 | 45416097 | 1513 |
| rs9534258 | 0.636 | 45418874 | 1514 |
| rs4460970 | 0.666 | 45438294 | 1515 |
| rs4941537 | 0.636 | 45440577 | 1516 |
| rs9534265 | 0.613 | 45445023 | 1517 |
| rs4942460 | 0.636 | 45448444 | 1518 |
| rs9316177 | 0.607 | 45459812 | 1519 |
| rs9534272 | 0.634 | 45464824 | 1520 |
| rs4941538 | 0.636 | 45484610 | 1521 |
| rs1409436 | 0.577 | 45512651 | 1522 |
| rs3783200 | 0.744 | 45514463 | 1523 |
| rs1087 | — | 45525440 | 1524 |
| rs9534304 | 0.96 | 45538603 | 1525 |
| rs9526136 | 0.957 | 45539148 | 1526 |
| rs9316179 | 0.961 | 45539467 | 1527 |
| rs9316180 | 0.961 | 45539686 | 1528 |
| rs9534305 | 0.724 | 45540157 | 1529 |
| rs9562635 | 0.958 | 45540993 | 1530 |
| rs7988836 | 0.917 | 45541374 | 1531 |
| rs7993537 | 0.961 | 45541562 | 1532 |
| rs9534307 | 0.961 | 45542131 | 1533 |
| rs9526140 | 0.961 | 45542153 | 1534 |
| rs9316181 | 0.961 | 45543741 | 1535 |
| rs1409434 | 0.961 | 45544445 | 1536 |
| rs3742264 | 0.961 | 45546095 | 1537 |
| rs9567613 | 0.961 | 45547399 | 1538 |
| rs11618062 | 0.961 | 45547569 | 1539 |
| rs9534312 | 0.961 | 45548220 | 1540 |
| rs9567615 | 0.956 | 45549081 | 1541 |
| rs9567618 | 0.961 | 45549309 | 1542 |
| rs1326398 | 0.885 | 45550691 | 1543 |
| rs723391 | 0.85 | 45553450 | 1544 |
| rs1952187 | 0.811 | 45572910 | 1546 |

EXAMPLE 72

For individuals with colorectal cancer, the distribution of polymorphic alleles at position 67187174 of chromosome 14, found within the ARG2 gene, was different from those without colorectal cancer (Table 72). The trend test for risk associated with carrying the C allele had an empirical p-value of 0.005073 based on permutation analysis, and the corresponding Mantel-Haenszel odds ratio for trend is 1.501 (Table 72). These data further suggest that this marker, located within the ARG2 gene, is associated with colorectal cancer risk and that the C allele at position 67187174 of chromosome 14 is associated with an increased risk of developing colorectal cancer.

TABLE 72

| rs no. | 10483802 |
|---|---|
| Chromosome; Position | 14; 67187174 |
| Gene Name | ARG2 |
| SEQ ID NO; Position | 1786; 30766 |
| Genotype; Phenotype | n = C; increased risk |
| Hardy-Weinberg | 1 |

| Case Flag | Allele B | AA | AB | BB | Model | p-Value | Odds Ratio |
|---|---|---|---|---|---|---|---|
| 0 | C | 901 | 69 | 1 | Trend | 0.005073 | 1.501 |
| 1 | C | 890 | 99 | 6 | | | |

Table 72A indicates SNPs found to be in strong linkage disequilibrium with rs10483802. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 72A

Linked SNPs

| SNP | $r^2$ | Position on chr14 | SEQ ID NO |
|---|---|---|---|
| rs12436474 | 1.0 | 67170429 | 1547 |
| rs8010798 | 1.0 | 67184920 | 1548 |
| rs10483802 | — | 67187174 | 1549 |
| rs15493 | 1.0 | 67187885 | 1550 |
| rs1804799 | 1.0 | 67188117 | 1551 |
| rs17249563 | 0.743 | 67194680 | 1552 |
| rs12435927 | 1.0 | 67197723 | 1553 |
| rs8013234 | 1.0 | 67219687 | 1554 |
| rs3759768 | 1.0 | 67233546 | 1555 |
| rs12434923 | 1.0 | 67239521 | 1556 |
| rs12435352 | 1.0 | 67241643 | 1557 |
| rs2009590 | 0.744 | 67257453 | 1558 |
| rs12431676 | 0.744 | 67258104 | 1559 |
| rs910315 | 0.743 | 67258676 | 1560 |
| rs718213 | 1.0 | 67266474 | 1561 |
| rs17836863 | 1.0 | 67276155 | 1562 |

EXAMPLE 73

For individuals with colorectal cancer, the distribution of polymorphic alleles at position 46146164 of chromosome 15 was different from those without colorectal cancer (Table 73). The trend test for risk associated with carrying the C allele had an empirical p-value of 0.001698 based on permutation analysis, and the corresponding Mantel-Haenszel odds ratio for trend is 1.230 (Table 73). These data further suggest that this marker is associated with colorectal cancer risk and that the C allele at position 46146164 of chromosome 15 is associated with an increased risk of developing colorectal cancer.

TABLE 73

| rs no. | 2469583 |
|---|---|
| Chromosome; Position | 15; 46146164 |
| Gene Name | |
| SEQ ID NO; Position | ; |
| Genotype; Phenotype | n = C; increased risk |
| Hardy-Weinberg | 0.60186 |

| Case Flag | Allele B | AA | AB | BB | Model | p-Value | Odds Ratio |
|---|---|---|---|---|---|---|---|
| 0 | C | 184 | 486 | 297 | Trend | 0.001698 | 1.230 |
| 1 | C | 150 | 476 | 363 | | | |

Table 73A indicates SNPs found to be in strong linkage disequilibrium with rs2469583. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 73A

Linked SNPs

| SNP | $r^2$ | Position on chr15 | SEQ ID NO |
|---|---|---|---|
| rs17423970 | 0.706 | 46089356 | 1563 |
| rs2081619 | 0.964 | 46101819 | 1564 |
| rs17424213 | 0.965 | 46103228 | 1565 |
| rs11070622 | 0.965 | 46108382 | 1566 |
| rs1869453 | 0.965 | 46111620 | 1567 |
| rs1426656 | 0.965 | 46114468 | 1568 |
| rs17340116 | 0.965 | 46114858 | 1569 |
| rs1453857 | 0.965 | 46116200 | 1570 |

TABLE 73A-continued

Linked SNPs

| SNP | $r^2$ | Position on chr15 | SEQ ID NO |
|---|---|---|---|
| rs1453856 | 0.965 | 46116311 | 1571 |
| rs12324567 | 0.965 | 46116717 | 1572 |
| rs748848 | 0.965 | 46118326 | 1573 |
| rs930016 | 0.962 | 46118529 | 1574 |
| rs930017 | 0.965 | 46118841 | 1575 |
| rs1453855 | 0.965 | 46120302 | 1576 |
| rs1025199 | 1.0 | 46126798 | 1577 |
| rs11070623 | 1.0 | 46136739 | 1578 |
| rs2433363 | 1.0 | 46139544 | 1579 |
| rs1426655 | 0.964 | 46145643 | 1580 |
| rs2469583 | — | 46146164 | 1581 |
| rs2469581 | 0.964 | 46149357 | 1582 |

EXAMPLE 74

For individuals with colorectal cancer, the distribution of polymorphic alleles at position 93233505 of chromosome 15 was different from those without colorectal cancer (Table 74). The trend test for risk associated with carrying the C allele had an empirical p-value of 0.00088 based on permutation analysis, and the corresponding Mantel-Haenszel odds ratio for trend is 1.280 (Table 74). These data further suggest that this marker is associated with colorectal cancer risk and that the C allele at position 93233505 of chromosome 15 is associated with an increased risk of developing colorectal cancer.

TABLE 74

| rs no. | 4372639 |
|---|---|
| Chromosome; Position | 15; 93233505 |
| Gene Name | |
| SEQ ID NO; Position | ; |
| Genotype; Phenotype | n = C; increased risk |
| Hardy-Weinberg | 0.44578 |

| Case Flag | Allele B | AA | AB | BB | Model | p-Value | Odds Ratio |
|---|---|---|---|---|---|---|---|
| 0 | C | 66 | 364 | 570 | Trend | 0.00088 | 1.280 |
| 1 | C | 43 | 321 | 636 | | | |

Table 74A indicates SNPs found to be in strong linkage disequilibrium with rs4372639. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 74A

Linked SNPs

| SNP | $r^2$ | Position on chr15 | SEQ ID NO |
|---|---|---|---|
| rs6496053 | 0.795 | 93195638 | 1583 |
| rs12439498 | 0.681 | 93202040 | 1584 |
| rs4984579 | 1.0 | 93217814 | 1585 |
| rs4489958 | 1.0 | 93221398 | 1586 |
| rs6416529 | 1.0 | 93222123 | 1587 |
| rs4247091 | 0.919 | 93226669 | 1588 |
| rs6496059 | 1.0 | 93229804 | 1589 |
| rs6496060 | 1.0 | 93231817 | 1590 |
| rs6496061 | 1.0 | 93232312 | 1591 |
| rs4372639 | — | 93233505 | 1592 |
| rs766233 | 0.742 | 93238457 | 1593 |
| rs12440481 | 1.0 | 93261273 | 1594 |

TABLE 74A-continued

Linked SNPs

| SNP | $r^2$ | Position on chr15 | SEQ ID NO |
|---|---|---|---|
| rs4306453 | 0.947 | 93263139 | 1595 |
| rs4247087 | 1.0 | 93264699 | 1596 |
| rs1562628 | 1.0 | 93265029 | 1597 |
| rs6496067 | 1.0 | 93266435 | 1598 |
| rs6496068 | 1.0 | 93266453 | 1599 |
| rs11630913 | 1.0 | 93267466 | 1600 |
| rs4283178 | 0.649 | 93274496 | 1601 |
| rs9920787 | 0.649 | 93277598 | 1602 |
| rs6416531 | 0.569 | 93279847 | 1603 |

EXAMPLE 75

For individuals with colorectal cancer, the distribution of polymorphic alleles at position 97282996 of chromosome 15, found within the IGF1R gene, was different from those without colorectal cancer (Table 75). The recessive test for risk associated with carrying the C allele had an empirical p-value of 0.0658 based on permutation analysis, and the corresponding recessive odds ratio is 1.311 (Table 75). These data further suggest that this marker, located within the IGF1R gene, is associated with colorectal cancer risk and that the C allele at position 97282996 of chromosome 15 is associated with an increased risk of developing colorectal cancer.

TABLE 75

| rs no. | 3743262 |
|---|---|
| Chromosome; Position | 15; 97282996 |
| Gene Name | IGF1R |
| SEQ ID NO; Position | 1787; 272709 |
| Genotype; Phenotype | n = C; increased risk |
| Hardy-Weinberg | 1 |

| Case Flag | Allele B | AA | AB | BB | Model | p-Value | Odds Ratio |
|---|---|---|---|---|---|---|---|
| 0 | C | 3 | 119 | 1087 | Recessive | 0.0658 | 1.311 |
| 1 | C | 6 | 91 | 1133 | | | |

Table 75A indicates SNPs found to be in strong linkage disequilibrium with rs3743262. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 75A

Linked SNPs

| SNP | $r^2$ | Position on chr15 | SEQ ID NO |
|---|---|---|---|
| rs3743262 | — | 97282996 | 1604 |

EXAMPLE 76

For individuals with colorectal cancer, the distribution of polymorphic alleles at position 99773203 of chromosome 15, found within the PCSK6 gene, was different from those without colorectal cancer (Table 76). The dominant test for risk associated with carrying the T allele had an empirical p-value based on permutation analysis of 0.003898, and the corresponding dominant odds ratio is 1.673 (Table 76). These data further suggest that this marker, located within the PCSK6 gene, is associated with colorectal cancer risk and that the T allele at position 99773203 of chromosome 15 is associated with an increased risk of developing colorectal cancer.

TABLE 76

| rs no. | 1994967 |
|---|---|
| Chromosome; Position | 15; 99773203 |
| Gene Name | PCSK6 |
| SEQ ID NO; Position | 1788; 74508 |
| Genotype; Phenotype | n = T; increased risk |
| Hardy-Weinberg | 0.24094 |

| Case Flag | Allele B | AA | AB | BB | Model | p-Value | Odds Ratio |
|---|---|---|---|---|---|---|---|
| 0 | T | 88 | 383 | 499 | Dominant | 0.003898 | 1.673 |
| 1 | T | 56 | 391 | 548 | | | |

Table 76A indicates SNPs found to be in strong linkage disequilibrium with rs1994967. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 76A

| Linked SNPs | | | |
|---|---|---|---|
| SNP | $r^2$ | Position on chr15 | SEQ ID NO |
| rs1532364 | 0.81 | 99768367 | 1605 |
| rs1000914 | 0.81 | 99768456 | 1606 |
| rs1108993 | 0.81 | 99768718 | 1607 |
| rs880452 | 0.81 | 99769785 | 1608 |
| rs7172235 | 1.0 | 99772560 | 1609 |
| rs12437488 | 1.0 | 99772834 | 1610 |
| rs12912500 | 1.0 | 99773041 | 1611 |
| rs1994967 | — | 99773203 | 1612 |
| rs1994968 | 0.554 | 99773242 | 1613 |
| rs4965856 | 1.0 | 99775105 | 1614 |
| rs4965857 | 1.0 | 99775156 | 1615 |
| rs12911482 | 1.0 | 99775985 | 1616 |
| rs2277585 | 0.515 | 99785607 | 1617 |

EXAMPLE 77

For individuals with colorectal cancer, the distribution of polymorphic alleles at position 5830572 of chromosome 16 was different from those without colorectal cancer (Table 77). The trend test for risk associated with carrying the G allele had an empirical p-value of 0.000314 based on permutation analysis, and the corresponding Mantel-Haenszel odds ratio for trend is 1.332 (Table 77). These data further suggest that this marker is associated with colorectal cancer risk and that the G allele at position 5830572 of chromosome 16 is associated with an increased risk of developing colorectal cancer.

TABLE 77

| rs no. | 7200548 |
|---|---|
| Chromosome; Position | 16; 5830572 |
| Gene Name | |
| SEQ ID NO; Position | ; |
| Genotype; Phenotype | n = G; increased risk |
| Hardy-Weinberg | 0.85932 |

TABLE 77-continued

| Case Flag | Allele B | AA | AB | BB | Model | p-Value | Odds Ratio |
|---|---|---|---|---|---|---|---|
| 0 | G | 53 | 353 | 565 | Trend | 0.000314 | 1.332 |
| 1 | G | 34 | 308 | 654 | | | |

Table 77A indicates SNPs found to be in strong linkage disequilibrium with rs7200548. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 77A

| Linked SNPs | | | |
|---|---|---|---|
| SNP | $r^2$ | Position on chr16 | SEQ ID NO |
| rs7187057 | 0.523 | 5806139 | 1618 |
| rs7189118 | 0.513 | 5806149 | 1619 |
| rs1865820 | 0.509 | 5806269 | 1620 |
| rs7189684 | 0.509 | 5806460 | 1621 |
| rs7195375 | 0.509 | 5807386 | 1622 |
| rs11648254 | 0.573 | 5807689 | 1623 |
| rs6500727 | 0.532 | 5808267 | 1624 |
| rs2342743 | 0.507 | 5808466 | 1625 |
| rs2342745 | 0.509 | 5808524 | 1626 |
| rs2342747 | 0.509 | 5808701 | 1627 |
| rs2342748 | 0.509 | 5808730 | 1628 |
| rs7200468 | 0.509 | 5809618 | 1629 |
| rs1550137 | 0.509 | 5810450 | 1630 |
| rs2343252 | 0.509 | 5812560 | 1631 |
| rs9930544 | 0.509 | 5813426 | 1632 |
| rs4296263 | 0.532 | 5819886 | 1633 |
| rs2118014 | 0.812 | 5828787 | 1634 |
| rs7200548 | — | 5830572 | 1635 |

EXAMPLE 78

For individuals with colorectal cancer, the distribution of polymorphic alleles at position 23619426 of chromosome 16, found within the LOC388226 gene, was different from those without colorectal cancer (Table 78). The trend test for risk associated with carrying the G allele had an empirical p-value of 0.005014 based on permutation analysis, and the corresponding Mantel-Haenszel odds ratio for trend is 1.212 (Table 78). These data further suggest that this marker, located within the LOC388226 gene, is associated with colorectal cancer risk and that the G allele at position 23619426 of chromosome 16 is associated with an increased risk of developing colorectal cancer.

TABLE 78

| rs no. | 26764 |
|---|---|
| Chromosome; Position | 16; 23619426 |
| Gene Name | LOC388226 |
| SEQ ID NO; Position | 1789; 12897 |
| Genotype; Phenotype | n = G; increased risk |
| Hardy-Weinberg | 0.61714 |

| Case Flag | Allele B | AA | AB | BB | Model | p-Value | Odds Ratio |
|---|---|---|---|---|---|---|---|
| 0 | G | 635 | 390 | 65 | Trend | 0.005014 | 1.212 |
| 1 | G | 573 | 425 | 87 | | | |

Table 78A indicates SNPs found to be in strong linkage disequilibrium with rs26764. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 78A

| | Linked SNPs | | |
|---|---|---|---|
| SNP | $r^2$ | Position on chr16 | SEQ ID NO |
| rs249856 | 0.638 | 23566477 | 1636 |
| rs249870 | 0.638 | 23573679 | 1637 |
| rs249869 | 0.566 | 23574058 | 1638 |
| rs249867 | 0.638 | 23576069 | 1639 |
| rs34514 | 0.637 | 23578098 | 1640 |
| rs34513 | 0.551 | 23579493 | 1641 |
| rs35586 | 0.638 | 23584507 | 1642 |
| rs35585 | 0.566 | 23584612 | 1643 |
| rs7588 | 0.638 | 23588666 | 1644 |
| rs40076 | 0.767 | 23599906 | 1645 |
| rs35635 | 0.566 | 23601271 | 1646 |
| rs42873 | 0.637 | 23602233 | 1647 |
| rs35634 | 0.638 | 23605180 | 1648 |
| rs26767 | 0.766 | 23605958 | 1649 |
| rs27770 | 0.638 | 23609039 | 1650 |
| rs35633 | 0.591 | 23611506 | 1651 |
| rs26764 | — | 23619426 | 1652 |
| rs26763 | 1.0 | 23619684 | 1653 |
| rs26762 | 1.0 | 23619949 | 1654 |
| rs11074570 | 0.857 | 23620229 | 1655 |

EXAMPLE 79

For individuals with colorectal cancer, the distribution of polymorphic alleles at position 13110425 of chromosome 17 was different from those without colorectal cancer (Table 79). The dominant test for risk associated with carrying the G allele had an empirical p-value based on permutation analysis of 0.022381, and the corresponding dominant odds ratio is 1.481 (Table 79). These data further suggest that this marker is associated with colorectal cancer risk and that the G allele at position 13110425 of chromosome 17 is associated with an increased risk of developing colorectal cancer.

TABLE 79

| rs no. | 1963296 |
|---|---|
| Chromosome; Position | 17; 13110425 |
| Gene Name | |
| SEQ ID NO; Position | ; |
| Genotype; Phenotype | n = G; increased risk |
| Hardy-Weinberg | 0.24539 |

| Case Flag | Allele B | AA | AB | BB | Model | p-Value | Odds Ratio |
|---|---|---|---|---|---|---|---|
| 0 | G | 89 | 393 | 518 | Dominant | 0.022381 | 1.481 |
| 1 | G | 62 | 399 | 541 | | | |

Table 79A indicates SNPs found to be in strong linkage disequilibrium with rs1963296. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 79A

| | Linked SNPs | | |
|---|---|---|---|
| SNP | $r^2$ | Position on chr17 | SEQ ID NO |
| rs1963296 | — | 13110425 | 1656 |
| rs3886341 | 1.0 | 13112831 | 1657 |
| rs11869275 | 0.956 | 13114370 | 1658 |
| rs7212267 | 0.955 | 13117081 | 1659 |
| rs2188894 | 0.831 | 13117504 | 1660 |
| rs2214260 | 0.831 | 13117537 | 1661 |

EXAMPLE 80

For individuals with colorectal cancer, the distribution of polymorphic alleles at position 30908917 of chromosome 17, found within the LOC342618 gene, was different from those without colorectal cancer (Table 80). The trend test for risk associated with carrying the C allele had an empirical p-value of 0.003563 based on permutation analysis, and the corresponding Mantel-Haenszel odds ratio for trend is 1.251 (Table 80). These data further suggest that this marker, located within the LOC342618 gene, is associated with colorectal cancer risk and that the C allele at position 30908917 of chromosome 17 is associated with an increased risk of developing colorectal cancer.

TABLE 80

| rs no. | 10512472 |
|---|---|
| Chromosome; Position | 17; 30908917 |
| Gene Name | LOC342618 |
| SEQ ID NO; Position | 1790; 278 |
| Genotype; Phenotype | n = C; increased risk |
| Hardy-Weinberg | 0.07034 |

| Case Flag | Allele B | AA | AB | BB | Model | p-Value | Odds Ratio |
|---|---|---|---|---|---|---|---|
| 0 | C | 685 | 295 | 20 | Trend | 0.003563 | 1.251 |
| 1 | C | 634 | 328 | 39 | | | |

Table 80A indicates SNPs found to be in strong linkage disequilibrium with rs10512472. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 80A

| | Linked SNPs | | |
|---|---|---|---|
| SNP | $r^2$ | Position on chr17 | SEQ ID NO |
| rs10512472 | — | 30908917 | 1662 |
| rs12940584 | 0.536 | 30912424 | 1663 |
| rs11655098 | 0.536 | 30918963 | 1664 |
| rs1037590 | 1.0 | 30926748 | 1665 |
| rs11656872 | 0.536 | 30962717 | 1666 |
| rs17669281 | 0.536 | 30967908 | 1667 |
| rs17606150 | 0.536 | 30967921 | 1668 |
| rs16971217 | 1.0 | 30968168 | 1669 |
| rs9897552 | 1.0 | 30998594 | 1670 |
| rs12943224 | 0.536 | 31001651 | 1671 |
| rs11652390 | 0.536 | 31006594 | 1672 |
| rs3506 | 0.536 | 31011147 | 1673 |
| rs11654542 | 0.536 | 31013421 | 1674 |
| rs17670584 | 0.536 | 31023017 | 1675 |
| rs17670614 | 0.536 | 31023480 | 1676 |
| rs9907772 | 1.0 | 31024741 | 1677 |

EXAMPLE 81

For individuals with colorectal cancer, the distribution of polymorphic alleles at position 34299961 of chromosome 18 was different from those without colorectal cancer (Table 81). The recessive test for risk associated with carrying the T allele had an empirical p-value of 0.015541 based on permutation analysis, and the corresponding recessive odds ratio is 1.770 (Table 81). These data further suggest that this marker is associated with colorectal cancer risk and that the T allele at position 34299961 of chromosome 18 is associated with an increased risk of developing colorectal cancer.

TABLE 81

| rs no. | 10502694 |
|---|---|
| Chromosome; Position | 18; 34299961 |
| Gene Name | |
| SEQ ID NO; Position | ; |
| Genotype; Phenotype | n = T; increased risk |
| Hardy-Weinberg | 0.18482 |

| Case Flag | Allele B | AA | AB | BB | Model | p-Value | Odds Ratio |
|---|---|---|---|---|---|---|---|
| 0 | T | 641 | 323 | 30 | Recessive | 0.015541 | 1.770 |
| 1 | T | 608 | 336 | 52 | | | |

Table 81A indicates SNPs found to be in strong linkage disequilibrium with rs10502694. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 81A

| Linked SNPs | | | |
|---|---|---|---|
| SNP | $r^2$ | Position on chr18 | SEQ ID NO |
| rs10502692 | 1.0 | 34294350 | 1680 |
| rs12373278 | 1.0 | 34294807 | 1681 |
| rs9954810 | 1.0 | 34297013 | 1682 |
| rs10502694 | — | 34299961 | 1683 |

EXAMPLE 82

For individuals with colorectal cancer, the distribution of polymorphic alleles at position 64600521 of chromosome 18 was different from those without colorectal cancer (Table 82). The trend test for risk associated with carrying the G allele had an empirical p-value of 0.004534 based on permutation analysis, and the corresponding Mantel-Haenszel odds ratio for trend is 1.945 (Table 82). These data further suggest that this marker is associated with colorectal cancer risk and that the G allele at position 64600521 of chromosome 18 is associated with an increased risk of developing colorectal cancer.

TABLE 80A-continued

| Linked SNPs | | | |
|---|---|---|---|
| SNP | $r^2$ | Position on chr17 | SEQ ID NO |
| rs17676508 | 0.536 | 31044721 | 1678 |
| rs17608253 | 0.536 | 31050583 | 1679 |

TABLE 82

| rs no. | 10503122 |
|---|---|
| Chromosome; Position | 18; 64600521 |
| Gene Name | |
| SEQ ID NO; Position | ; |
| Genotype; Phenotype | n = G; increased risk |
| Hardy-Weinberg | 1 |

| Case Flag | Allele B | AA | AB | BB | Model | p-Value | Odds Ratio |
|---|---|---|---|---|---|---|---|
| 0 | G | 0 | 53 | 947 | Trend | 0.004534 | 1.945 |
| 1 | G | 0 | 28 | 973 | | | |

Table 82A indicates SNPs found to be in strong linkage disequilibrium with rs10503122. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 82A

| Linked SNPs | | | |
|---|---|---|---|
| SNP | $r^2$ | Position on chr18 | SEQ ID NO |
| rs646985 | 1.0 | 64574312 | 1684 |
| rs17079646 | 1.0 | 64575303 | 1685 |
| rs631470 | 1.0 | 64575455 | 1686 |
| rs1676846 | 1.0 | 64577169 | 1687 |
| rs12458298 | 1.0 | 64577779 | 1688 |
| rs17079657 | 1.0 | 64578874 | 1689 |
| rs679650 | 1.0 | 64579596 | 1690 |
| rs12604145 | 1.0 | 64580779 | 1691 |
| rs17079677 | 1.0 | 64584139 | 1692 |
| rs491835 | 1.0 | 64586668 | 1693 |
| rs12457185 | 1.0 | 64588166 | 1694 |
| rs12454555 | 1.0 | 64588368 | 1695 |
| rs12455204 | 1.0 | 64589299 | 1696 |
| rs12607604 | 1.0 | 64591510 | 1697 |
| rs595015 | 1.0 | 64592428 | 1698 |
| rs607696 | 1.0 | 64592919 | 1699 |
| rs12454311 | 1.0 | 64593139 | 1700 |
| rs11151464 | 1.0 | 64595151 | 1701 |
| rs17079696 | 1.0 | 64595371 | 1702 |
| rs677592 | 1.0 | 64596256 | 1703 |
| rs11151465 | 1.0 | 64596392 | 1704 |
| rs499881 | 1.0 | 64596771 | 1705 |
| rs1676853 | 1.0 | 64600350 | 1706 |
| rs10503122 | — | 64600521 | 1707 |
| rs656681 | 1.0 | 64601827 | 1708 |
| rs17079705 | 1.0 | 64602989 | 1709 |
| rs8092610 | 1.0 | 64612870 | 1710 |
| rs17079717 | 1.0 | 64618545 | 1711 |

EXAMPLE 83

For individuals with colorectal cancer, the distribution of polymorphic alleles at position 59485642 of chromosome 19 was different from those without colorectal cancer (Table 83). The dominant test for risk associated with carrying the C allele had an empirical p-value based on permutation analysis of 0.000472, and the corresponding dominant odds ratio is 1.401 (Table 83). These data further suggest that this marker is associated with colorectal cancer risk and that the C allele at position 59485642 of chromosome 19 is associated with an increased risk of developing colorectal cancer.

TABLE 83

| rs no. | 798893 |
|---|---|
| Chromosome; Position | 19; 59485642 |
| Gene Name | |
| SEQ ID NO; Position | ; |
| Genotype; Phenotype | n = C; increased risk |
| Hardy-Weinberg | 0.26927 |

| Case Flag | Allele B | AA | AB | BB | Model | p-Value | Odds Ratio |
|---|---|---|---|---|---|---|---|
| 0 | C | 628 | 266 | 36 | Dominant | 0.000472 | 1.401 |
| 1 | C | 567 | 331 | 51 | | | |

Table 83A indicates SNPs found to be in strong linkage disequilibrium with rs798893. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 83A

Linked SNPs

| SNP | $r^2$ | Position on chr19 | SEQ ID NO |
|---|---|---|---|
| rs383369 | 0.535 | 59475942 | 1712 |
| rs431420 | 0.583 | 59483891 | 1713 |
| rs386000 | 0.875 | 59484573 | 1714 |
| rs398217 | 0.856 | 59484850 | 1715 |
| rs798887 | 0.937 | 59485000 | 1716 |
| rs798893 | — | 59485642 | 1717 |
| rs416867 | 0.883 | 59488442 | 1718 |
| rs384116 | 0.891 | 59488531 | 1719 |
| rs103294 | 0.945 | 59489660 | 1720 |
| rs410852 | 0.619 | 59492183 | 1721 |

EXAMPLE 84

For individuals with colorectal cancer, the distribution of polymorphic alleles at position 20272988 of chromosome 21 was different from those without colorectal cancer (Table 84). The recessive test for risk associated with carrying the T allele had an empirical p-value of 0.00021 based on permutation analysis, and the corresponding recessive odds ratio is 1.465 (Table 84). These data further suggest that this marker is associated with colorectal cancer risk and that the T allele at position 20272988 of chromosome 21 is associated with an increased risk of developing colorectal cancer.

TABLE 84

| rs no. | 377685 |
|---|---|
| Chromosome; Position | 21; 20272988 |
| Gene Name | |
| SEQ ID NO; Position | ; |
| Genotype; Phenotype | n = T; increased risk |
| Hardy-Weinberg | 0.31086 |

| Case Flag | Allele B | AA | AB | BB | Model | p-Value | Odds Ratio |
|---|---|---|---|---|---|---|---|
| 0 | T | 264 | 515 | 220 | Recessive | 0.00021 | 1.465 |
| 1 | T | 256 | 452 | 293 | | | |

Table 84A indicates SNPs found to be in strong linkage disequilibrium with rs377685. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 84A

Linked SNPs

| SNP | $r^2$ | Position on chr21 | SEQ ID NO |
|---|---|---|---|
| rs2825896 | 0.564 | 20218657 | 1722 |
| rs2825899 | 0.571 | 20222308 | 1723 |
| rs2825905 | 0.561 | 20226492 | 1724 |
| rs2825910 | 0.591 | 20228734 | 1725 |
| rs12482291 | 0.591 | 20232506 | 1726 |
| rs2825922 | 0.714 | 20243479 | 1727 |
| rs13047152 | 0.714 | 20257959 | 1728 |
| rs12482827 | 0.714 | 20261725 | 1729 |
| rs377685 | — | 20272988 | 1730 |
| rs7281221 | 0.51 | 20274521 | 1731 |
| rs2825928 | 0.522 | 20274865 | 1732 |
| rs2825930 | 1.0 | 20279236 | 1733 |
| rs12482714 | 1.0 | 20282727 | 1734 |
| rs2825941 | 0.966 | 20308050 | 1735 |

EXAMPLE 85

For individuals with colorectal cancer, the distribution of polymorphic alleles at position 19773582 of chromosome 22 was different from those without colorectal cancer (Table 85). The recessive test for risk associated with carrying the G allele had an empirical p-value of 0.007571 based on permutation analysis, and the corresponding recessive odds ratio is 1.541 (Table 85). These data further suggest that this marker is associated with colorectal cancer risk and that the G allele at position 19773582 of chromosome 22 is associated with an increased risk of developing colorectal cancer.

TABLE 85

| rs no. | 431319 |
|---|---|
| Chromosome; Position | 22; 19773582 |
| Gene Name | |
| SEQ ID NO; Position | ; |
| Genotype; Phenotype | n = G; increased risk |
| Hardy-Weinberg | 0.74998 |

| Case Flag | Allele B | AA | AB | BB | Model | p-Value | Odds Ratio |
|---|---|---|---|---|---|---|---|
| 0 | G | 526 | 402 | 72 | Recessive | 0.007571 | 1.541 |
| 1 | G | 486 | 409 | 107 | | | |

Table 85A indicates SNPs found to be in strong linkage disequilibrium with rs431319. To generate this list, correlation coefficients ($r^2$) were calculated between the index SNP and all neighboring SNPs cited in the January 2007 HapMap data set release. An $r^2$ cut off of 0.50 was selected for inclusion as evidence for strong genetic linkage, i.e., a "strong linkage disequilibrium".

TABLE 85A

Linked SNPs

| SNP | $r^2$ | Position on chr22 | SEQ ID NO |
|---|---|---|---|
| rs727497 | 0.598 | 19751933 | 1736 |
| rs9613607 | 0.598 | 19752848 | 1737 |
| rs6417766 | 0.64 | 19756298 | 1738 |
| rs6519750 | 0.566 | 19756323 | 1739 |
| rs9608684 | 0.573 | 19756976 | 1740 |

TABLE 85A-continued

Linked SNPs

| SNP | r² | Position on chr22 | SEQ ID NO |
|---|---|---|---|
| rs9613641 | 0.565 | 19764380 | 1741 |
| rs444763 | 0.855 | 19767837 | 1742 |
| rs415591 | 0.855 | 19769591 | 1743 |
| rs399401 | 0.851 | 19769618 | 1744 |
| rs933582 | 0.855 | 19769950 | 1745 |
| rs11913109 | 0.519 | 19771148 | 1746 |
| rs11912450 | 0.519 | 19771633 | 1747 |
| rs1210599 | 1.0 | 19772588 | 1748 |
| rs444204 | 1.0 | 19772956 | 1749 |
| rs365421 | 1.0 | 19772978 | 1750 |
| rs367594 | 1.0 | 19773492 | 1751 |
| rs431319 | — | 19773582 | 1752 |
| rs448041 | 1.0 | 19773965 | 1753 |
| rs6005623 | 0.623 | 19774278 | 1754 |
| rs9306459 | 0.632 | 19774574 | 1755 |
| rs9608693 | 0.601 | 19774735 | 1756 |
| rs6005625 | 0.625 | 19774818 | 1757 |
| rs5997305 | 0.625 | 19775246 | 1758 |
| rs1210606 | 0.885 | 19776791 | 1759 |
| rs406160 | 0.963 | 19778477 | 1760 |

TABLE 86

Modifying effect of the estrogen receptor beta rs1256033 polymorphism on the colorectal risk predicting properties of rs10505477 overall ("OR").

Samples from the Ontario Familial Colorectal Cancer Registry
Multiplicative effect of each "A" allele in rs10505477 (OR = 1.22, p = 0.00044)
Modifying effects of estrogen receptor beta rs1256033
Gene Name: estrogen receptor beta; SEQ ID NO: 1836

| C/C | C/T or T/T |
|---|---|
| OR = 1.09 p = 0.42; N = 664 | OR = 1.31; p = 0.00015; N = 1568 |

Samples from the Ontario Familial Colorectal Cancer Registry
Multiplicative effect of each "A" allele in rs10505477 by gender alone and in combination with the estrogen receptor beta SNP rs1256033

| Male | | Female | |
|---|---|---|---|
| OR = 1.27; p = 0.005 | | OR = 1.18; p = 0.044 | |
| estrogen receptor beta: rs1256033 | | estrogen receptor beta: rs1256033 | |
| C/C (N = 344) | C/T or T/T (N = 772) | C/C (N = 303) | C/T or T/T (N = 755) |
| OR = 1.16 p = 0.35 | OR = 1.33 p = 0.006 | OR = 0.97 p = 0.86 | OR = 1.29 p = 0.012 |

Table 86A indicates SNPs found to be in strong linkage disequilibrium with rs1256033. To generate this list, correlation coefficients (r²) were calculated between the index SNP and all neighboring SNPs cited in the January 2007 HapMap data set release. An r² cut off of 0.50 was selected for inclusion as evidence for strong genetic linkage, i.e., a "strong linkage disequilibrium".

TABLE 86A

Linked SNPs

| SNP | r² | Position on chr14 | SEQ ID NO |
|---|---|---|---|
| rs1152591 | 0.523 | 63750601 | 1791 |
| rs1152589 | 0.582 | 63753679 | 1792 |
| rs915057 | 0.743 | 63755960 | 1793 |
| rs1152588 | 0.803 | 63757928 | 1794 |
| rs1152582 | 0.773 | 63762383 | 1795 |
| rs928554 | 0.735 | 63763948 | 1796 |
| rs1152579 | 0.73 | 63764840 | 1797 |
| rs1152578 | 0.761 | 63766790 | 1798 |
| rs1256065 | 0.752 | 63768685 | 1799 |
| rs1256061 | 0.646 | 63773346 | 1800 |
| rs1256059 | 0.796 | 63780170 | 1801 |
| rs1256056 | 0.803 | 63782379 | 1802 |
| rs4365213 | 0.583 | 63790017 | 1803 |
| rs6573549 | 0.584 | 63791402 | 1804 |
| rs12435857 | 0.579 | 63793278 | 1805 |
| rs1256048 | 0.87 | 63798033 | 1806 |
| rs1256045 | 0.87 | 63799513 | 1807 |
| rs1256044 | 0.87 | 63803780 | 1808 |
| rs1256043 | 0.845 | 63804035 | 1809 |
| rs10148269 | 0.87 | 63806677 | 1810 |
| rs1271573 | 0.868 | 63807224 | 1811 |
| rs1256040 | 1.0 | 63808147 | 1812 |
| rs11158536 | 0.873 | 63809928 | 1813 |
| rs1256038 | 0.867 | 63810492 | 1814 |
| rs1256037 | 0.869 | 63813054 | 1815 |
| rs1256036 | 0.87 | 63813085 | 1816 |
| rs1269056 | 0.87 | 63813643 | 1817 |
| rs960069 | 0.845 | 63814755 | 1818 |
| rs960070 | 0.873 | 63814932 | 1819 |
| rs1256033 | — | 63815152 | 1820 |
| rs1256031 | 1.0 | 63815932 | 1821 |
| rs1256030 | 1.0 | 63816923 | 1822 |
| rs3783736 | 0.528 | 63821125 | 1823 |
| rs6573553 | 0.844 | 63824114 | 1824 |
| rs1271572 | 0.93 | 63831670 | 1825 |
| rs3020445 | 0.775 | 63858397 | 1826 |
| rs2357479 | 0.684 | 63862517 | 1827 |
| rs1256112 | 0.595 | 63884064 | 1828 |
| rs1256111 | 0.547 | 63886152 | 1829 |
| rs1256110 | 0.595 | 63886610 | 1830 |
| rs10146204 | 0.52 | 63888522 | 1831 |
| rs1256108 | 0.547 | 63891973 | 1832 |
| rs1256107 | 0.547 | 63893134 | 1833 |
| rs1256101 | 0.547 | 63899770 | 1834 |
| rs1256093 | 0.518 | 63912505 | 1835 |

Another aspect of the invention is a method of diagnosing colorectal cancer in an individual, or determining whether the individual is at altered risk for colorectal cancer, by detecting polymorphism in a subject by treating a tissue sample from the subject with an antibody to a polymorphic genetic variant of the present invention and detecting binding of said antibody. A person of skill in the art would know how to produce such an antibody (see, for instance, Harlow, E. and Lane, eds., 1988, "Antibodies: A Laboratory Manual", Cold Spring Harbor Press, Cold Spring Harbor). Such antibodies may include, but are not limited to polyclonal antibodies, monoclonal antibodies (mAbs), humanized or chimeric antibodies, single chain antibodies, Fab fragments, F(ab')$_2$ fragments, fragments produced by a Fab expression library, anti-idiotypic (anti-Id) antibodies, and epitope-binding fragments of any of the above. The present invention also provides an animal model to study colorectal cancer and susceptibility to colorectal cancer. Such studies can be performed using transgenic animals. For example, one can produce transgenic mice, which contain a specific allelic variant of a containing any of the SNPs disclosed herein. These mice can be created, e.g., by replacing their wild-type gene with an allele containing a SNP disclosed herein, or of the corresponding human gene containing such a SNP.

In a preferred embodiment, the present invention provides a transgenic mammalian animal, said animal having cells incorporating a recombinant expression system adapted to express a gene containing a SNP disclosed herein (preferably the human gene containing a SNP disclosed herein). Generally, the recombinant expression system will be stably integrated into the genome of the transgenic animal and will thus be heritable so that the offspring of such a transgenic animal may themselves contain the transgene. Transgenic animals can be engineered by introducing the a nucleic acid molecule containing only the coding portion of the gene into the genome of animals of interest, using standard techniques for producing transgenic animals. Animals that can serve as a target for transgenic manipulation include, without limitation, mice, rats, rabbits, guinea pigs, sheep, goats, pigs, and non-human primates, e.g. baboons, chimpanzees and monkeys. Techniques known in the art to introduce a transgene into such animals include pronucleic microinjection (U.S. Pat. No. 4,873,191); retrovirus-mediated gene transfer into germ lines (e.g. Van der Putten et al. 1985, Proc. Natl. Acad. Sci. USA 82: 6148-6152); gene targeting in embryonic stem cells (Thompson et al., Cell 56 (1989), 313-321); electroporation of embryos and sperm-mediated gene transfer (for a review, see for example, U.S. Pat. No. 4,736,866). For the purpose of the present invention, transgenic animals include those that carry the recombinant molecule only in part of their cells ("mosaic animals"). The molecule can be integrated either as a single transgene, or in concatamers. Selective introduction of a nucleic acid molecule into a particular cell type is also possible by following, for example, the technique of Lasko et al., Proc. Natl. Acad. Sci. USA 89 (1992): 6232-6236. Particular cells could also be targeted for molecular incorporation with tissue-specific enhancers. The expression of the integrated molecule can be monitored by standard techniques such as in situ hybridization, Northern Blot analysis, PCR or immunocytochemistry. Transgenic animals that include a copy of such a nucleic acid molecule introduced into the germ line of the animal at an embryonic stage can be used to examine the effect of increased expression of DNA encoding the corresponding protein. In accordance with this facet of the invention, an animal is treated with the reagent and a reduced incidence of the pathological condition, compared to untreated animals bearing the transgene, would indicate a potential therapeutic intervention for the pathological condition.

The present invention has been described in detail by way of illustration and example in order to acquaint others skilled in the art with the invention, its principles and its practical application. Particular formulations and processes of the present invention are not limited to the descriptions of the specific embodiments presented, but rather the descriptions and examples should be viewed in terms of the claims that follow and their equivalents. While some of the examples and descriptions above include some conclusions about the way the invention may function, the inventors do not intend to be bound by those conclusions and functions, but put them forth only as possible explanations.

It is to be further understood that the specific embodiments of the present invention as set forth are not intended as being exhaustive or limiting of the invention, and that many alternatives, modifications and variations will be apparent to those of ordinary skill in the art in light of the foregoing examples and detailed description. Accordingly, this invention is intended to embrace all such alternatives, modifications and variations that fall within the spirit and scope of the following claims.

REFERENCE LIST

All publications mentioned in the specification are herein incorporated by reference to the same extent as if each individual publication was specifically and individually indicated to be incorporated by reference herein.

(1999) *Current Protocols in Molecular Biology*. Wiley, New York.

(2005) *Remington's Pharmaceutical Sciences*. Mack.

Abderrahmani A, Steinmann M, Plaisance V, Niederhauser G, Haefliger J A, Mooser V, Bonny C, Nicod P and Waeber G (2001) The Transcriptional Repressor REST Determines the Cell-Specific Expression of the Human MAPK8IP1 Gene Encoding IB1 (JIP-1). *Mol Cell Biol* 21: pp 7256-7267.

Abecasis G R, Noguchi E, Heinzmann A, Traherne J A, Bhattacharyya S, Leaves N I, Anderson G G, Zhang Y, Lench N J, Carey A, Cardon L R, Moffatt M F and Cookson W O (2001) Extent and Distribution of Linkage Disequilibrium in Three Genomic Regions. *Am J Hum Genet* 68: pp 191-197.

Agresti A (2001) Exact Inference for Categorical Data: Recent Advances and Continuing Controversies. *Stat Med* 20: pp 2709-2722.

Ansell R J, Kriz D and Mosbach K (1996) Molecularly Imprinted Polymers for Bioanalysis: Chromatography, Binding Assays and Biomimetic Sensors. *Curr Opin Biotechnol* 7: pp 89-94.

Banerji J, Olson L and Schaffner W (1983) A Lymphocyte-Specific Cellular Enhancer Is Located Downstream of the Joining Region in Immunoglobulin Heavy Chain Genes. *Cell* 33: pp 729-740.

Bartel D P and Szostak J W (1993) Isolation of New Ribozymes From a Large Pool of Random Sequences. *Science* 261: pp 1411-1418.

Bartel P, Chien C T, Sternglanz R and Fields S (1993) Elimination of False Positives That Arise in Using the Two-Hybrid System. *Biotechniques* 14: pp 920-924.

Beidler C B, Ludwig J R, Cardenas J, Phelps J, Papworth C G, Melcher E, Sierzega M, Myers L J, Unger B W, Fisher M and. (1988) Cloning and High Level Expression of a Chimeric Antibody With Specificity for Human Carcinoembryonic Antigen. *J Immunol* 141: pp 4053-4060.

Better M, Chang C P, Robinson R R and Horwitz A H (1988) *Escherichia Coli* Secretion of an Active Chimeric Antibody Fragment. *Science* 240: pp 1041-1043.

Bhattacharya-Chatterjee M and Foon K A (1998) Anti-Idiotype Antibody Vaccine Therapies of Cancer. *Cancer Treat Res* 94:51-68: pp 51-68.

Bosher J M and Labouesse M (2000) RNA Interference: Genetic Wand and Genetic Watchdog. *Nat Cell Biol* 2: pp E31-E36.

Byrne G W and Ruddle F H (1989) Multiplex Gene Regulation: a Two-Tiered Approach to Transgene Regulation in Transgenic Mice. *Proc Natl Acad Sci USA* 86: pp 5473-5477.

Calame K and Eaton S (1988) Transcriptional Controlling Elements in the Immunoglobulin and T Cell Receptor Loci. *Adv Immunol* 43:235-75: pp 235-275.

Camper S A and Tilghman S M (1989) Postnatal Repression of the Alpha-Fetoprotein Gene Is Enhancer Independent. *Genes Dev* 3: pp 537-546.

Caplen N J, Parrish S, Imani F, Fire A and Morgan R A (2001a) Specific Inhibition of Gene Expression by Small Double-Stranded RNAs in Invertebrate and Vertebrate Systems. *Proc Natl Acad Sci USA* 98: pp 9742-9747.

Caplen N J, Parrish S, Imani F, Fire A and Morgan R A (2001b) Specific Inhibition of Gene Expression by Small Double-Stranded RNAs in Invertebrate and Vertebrate Systems. *Proc Natl Acad Sci USA* 98: pp 9742-9747.

Carstensen B, Soll-Johanning H, Villadsen E, Sondergaard J O and Lynge E (1996) Familial Aggregation of Colorectal Cancer in the General Population. *Int J Cancer* 68: pp 428-435.

Chen S H, Shine H D, Goodman J C, Grossman R G and Woo S L (1994) Gene Therapy for Brain Tumors Regression of Experimental Gliomas by Adenovirus-Mediated Gene Transfer in Vivo. *Proc Natl Acad Sci USA* 91: pp 3054-3057.

Cho C Y, Moran E J, Chemy S R, Stephans J C, Fodor S P, Adams C L, Sundaram A, Jacobs J W and Schultz P G (1993) An Unnatural Biopolymer. *Science* 261: pp 1303-1305.

Clark A G, Weiss K M, Nickerson D A, Taylor S L, Buchanan A, Stengard J, Salomaa V, Vartiainen E, Perola M, Boerwinkle E and Sing C F (1998) Haplotype Structure and Population Genetic Inferences From Nucleotide-Sequence Variation in Human Lipoprotein Lipase. *Am J Hum Genet* 63: pp 595-612.

Colcher D, Pavlinkova G, Beresford G, Booth B J and Batra S K (1999) Single-Chain Antibodies in Pancreatic Cancer. *Ann NY Acad Sci* 880:263-80: pp 263-280.

Collins F S, Brooks L D and Chakravarti A (1998) A DNA Polymorphism Discovery Resource for Research on Human Genetic Variation. *Genome Res* 8: pp 1229-1231.

Cotton R G, Rodrigues N R and Campbell R D (1988) Reactivity of Cytosine and Thymine in Single-Base-Pair Mismatches With Hydroxylamine and Osmium Tetroxide and Its Application to the Study of Mutations. *Proc Natl Acad Sci USA* 85: pp 4397-4401.

Cronin M T, Fucini R V, Kim S M, Masino R S, Wespi R M and Miyada C G (1996) Cystic Fibrosis Mutation Detection by Hybridization to Light-Generated DNA Probe Arrays. *Hum Mutat* 7: pp 244-255.

Crow J F (1995) Spontaneous Mutation As a Risk Factor. *Exp Clin Immunogenet* 12: pp 121-128.

Cruikshank W W, Doctrow S R, Falvo M S, Huffman K, Maciaszek J, Viglianti G, Raina J, Kornfeld H and Malfroy B (1997) A Lipidated Anti-Tat Antibody Enters Living Cells and Blocks HIV-1 Viral Replication. *J Acquir Immune Defic Syndr Hum Retrovirol* 14: pp 193-203.

Cull M G, Miller J F and Schatz P J (1992) Screening for Receptor Ligands Using Large Libraries of Peptides Linked to the C Terminus of the Lac Repressor. *Proc Natl Acad Sci USA* 89: pp 1865-1869.

Cwirla S E, Peters E A, Barrett R W and Dower W J (1990) Peptides on Phage: a Vast Library of Peptides for Identifying Ligands. *Proc Natl Acad Sci USA* 87: pp 6378-6382.

Daly M J, Rioux J D, Schaffner S F, Hudson T J and Lander E S (2001) High-Resolution Haplotype Structure in the Human Genome. *Nat Genet* 29: pp 229-232.

Dawson E, Abecasis G R, Bumpstead S, Chen Y, Hunt S, Beare D M, Pabial J, Dibling T, Tinsley E, Kirby S, Carter D, Papaspyridonos M, Livingstone S, Ganske R, Lohmussaar E, Zernant J, Tonisson N, Remm M, Magi R, Puurand T, Vilo J, Kurg A, Rice K, Deloukas P, Mott R, Metspalu A, Bentley D R, Cardon L R and Dunham I (2002) A First-Generation Linkage Disequilibrium Map of Human Chromosome 22. *Nature* 418: pp 544-548.

de Leon M P, Pedroni M, Benatti P, Percesepe A, Di Gregorio C, Foroni M, Rossi G, Genuardi M, Neri G, Leonardi F, Viel A, Capozzi E, Boiocchi M and Roncucci L (1999) Hereditary Colorectal Cancer in the General Population: From Cancer Registration to Molecular Diagnosis. *Gut* 45: pp 32-38.

Devlin J J, Panganiban L C and Devlin P E (1990) Random Peptide Libraries: a Source of Specific Protein Binding Molecules. *Science* 249: pp 404-406.

DeWitt S H, Kiely J S, Stankovic C J, Schroeder M C, Cody D M and Pavia M R (1993) "Diversomers": an Approach to Nonpeptide, Nonoligomeric Chemical Diversity. *Proc Natl Acad Sci USA* 90: pp 6909-6913.

Dunning A M, Durocher F, Healey C S, Teare M D, McBride S E, Carlomagno F, Xu C F, Dawson E, Rhodes S, Ueda S, Lai E, Luben R N, Van Rensburg E J, Mannermaa A, Kataja V, Rennart G, Dunham I, Purvis I, Easton D and Ponder B A (2000) The Extent of Linkage Disequilibrium in Four Populations With Distinct Demographic Histories. *Am J Hum Genet* 67: pp 1544-1554.

Edlund T, Walker M D, Barr P J and Rutter W J (1985) Cell-Specific Expression of the Rat Insulin Gene Evidence for Role of Two Distinct 5'Flanking Elements. *Science* 230: pp 912-916.

Elbashir S M, Harborth J, Weber K and Tuschl T (2002) Analysis of Gene Function in Somatic Mammalian Cells Using Small Interfering RNAs. *Methods* 26: pp 199-213.

Erb E, Janda K D and Brenner S (1994) Recursive Deconvolution of Combinatorial Chemical Libraries. *Proc Natl Acad Sci USA* 91: pp 11422-11426.

Felici F, Castagnoli L, Musacchio A, Jappelli R and Cesareni G (1991) Selection of Antibody Ligands From a Large Library of Oligopeptides Expressed on a Multivalent Exposition Vector. *J Mol Biol* 222: pp 301-310.

Fodor S P, Rava R P, Huang X C, Pease A C, Holmes C P and Adams C L (1993) Multiplexed Biochemical Assays With Biological Chips. *Nature* 364: pp 555-556.

Gabriel S B, Schaffner S F, Nguyen H, Moore J M, Roy J, Blumenstiel B, Higgins J, DeFelice M, Lochner A, Faggart M, Liu-Cordero S N, Rotimi C, Adeyemo A, Cooper R, Ward R, Lander E S, Daly M J and Altshuler D (2002) The Structure of Haplotype Blocks in the Human Genome. *Science* 296: pp 2225-2229.

Gallop M A, Barrett R W, Dower W J, Fodor S P and Gordon E M (1994) Applications of Combinatorial Technologies to Drug Discovery. 1. Background and Peptide Combinatorial Libraries. *J Med Chem* 37: pp 1233-1251.

Gautier C, Morvan F, Rayner B, Huynh-Dinh T, Igolen J, Imbach J L, Paoletti C and Paoletti J (1987) Alpha-DNA. IV: Alpha-Anomeric and Beta-Anomeric Tetrathymidylates Covalently Linked to Intercalating Oxazolopyridocarbazole. Synthesis, Physicochemical Properties and Poly (RA) Binding. *Nucleic Acids Res* 15: pp 6625-6641.

Goeddel D V (1990) Systems for Heterologous Gene Expression. *Methods Enzymol* 185:3-7: pp 3-7.

Gottesman S (1990) Minimizing Proteolysis in *Escherichia Coli*: Genetic Solutions. *Methods Enzymol* 185:119-29: pp 119-129.

Hage D S and Tweed S A (1997) Recent Advances in Chromatographic and Electrophoretic Methods for the Study of Drug-Protein Interactions. *J Chromatogr B Biomed Sci Appl* 699: pp 499-525.

Haseloff J and Gerlach W L (1988) Simple RNA Enzymes With New and Highly Specific Endoribonuclease Activities. *Nature* 334: pp 585-591.

Heegaard N H (1998) Capillary Electrophoresis for the Study of Affinity Interactions. *J Mol Recognit* 11: pp 141-148.

Helene C (1991) The Anti-Gene Strategy: Control of Gene Expression by Triplex-Forming-Oligonucleotides. *Anticancer Drug Des* 6: pp 569-584.

Helene C, Thuong N T and Harel-Bellan A (1992) Control of Gene Expression by Triple Helix-Forming Oligonucleotides. The Antigene Strategy. *Ann NY Acad Sci* 660:27-36: pp 27-36.

Herlyn D and Birebent B (1999) Advances in Cancer Vaccine Development. *Ann Med* 31: pp 66-78.

Herzog T J (2003) New approaches for the management of cervical cancer. *Gynecol Oncol*. (3 Pt 2):S22-7.

Houghten R A, Appel J R, Blondelle S E, Cuervo J H, Dooley C T and Pinilla C (1992) The Use of Synthetic Peptide Combinatorial Libraries for the Identification of Bioactive Peptides. *Biotechniques* 13: pp 412-421.

Hyrup B and Nielsen P E (1996) Peptide Nucleic Acids (PNA): Synthesis, Properties and Potential Applications. *Bioorg Med Chem* 4: pp 5-23.

Inoue H, Hayase Y, Imura A, Twai S, Miura K and Ohtsuka E (1987a) Synthesis and Hybridization Studies on Two Complementary Nona (2'-O-Methyl)Ribonucleotides. *Nucleic Acids Res* 15: pp 6131-6148.

Inoue H, Hayase Y, Iwai S and Ohtsuka E (1987b) Sequence-Dependent Hydrolysis of RNA Using Modified Oligonucleotide Splints and RNase H. *FEBS Lett* 215: pp 327-330.

Iwabuchi K, Li B, Bartel P and Fields S (1993) Use of the Two-Hybrid System to Identify the Domain of P53 Involved in Oligomerization. *Oncogene* 8: pp 1693-1696.

Jespers L S, Roberts A, Mahler S M, Winter G and Hoogenboom H R (1994) Guiding the Selection of Human Antibodies From Phage Display Repertoires to a Single Epitope of an Antigen. *Biotechnology (NY)* 12: pp 899-903.

Kessel M and Gruss P (1990) Murine Developmental Control Genes. *Science* 249: pp 374-379.

Kikuchi T, Daigo Y, Katagiri T, Tsunoda T, Okada K, Kakiuchi S, Zembutsu H, Furukawa Y, Kawamura M, Kobayashi K, Imai K and Nakamura Y (2003) Expression Profiles of Non-Small Cell Lung Cancers on cDNA Microarrays: Identification of Genes for Prediction of Lymph-Node Metastasis and Sensitivity to Anti-Cancer Drugs. *Oncogene* 22: pp 2192-2205.

Kondrashov A S (1995) Contamination of the Genome by Very Slightly Deleterious Mutations: Why Have We Not Died 100 Times Over? *J Theor Biol* 175: pp 583-594.

Kozal M J, Shah N, Shen N, Yang R, Fucini R, Merigan T C, Richman D D, Morris D, Hubbell E, Chee M and Gingeras T R (1996) Extensive Polymorphisms Observed in HIV-1 Clade B Protease Gene Using High-Density Oligonucleotide Arrays. *Nat Med* 2: pp 753-759.

Lam K S (1997) Application of Combinatorial Library Methods in Cancer Research and Drug Discovery. *Anticancer Drug Des* 12: pp 145-167.

Lam K S, Salmon S E, Hersh E M, Hruby V J, Kazmierski W M and Knapp R J (1991) A New Type of Synthetic Peptide Library for Identifying Ligand-Binding Activity. *Nature* 354: pp 82-84.

Lemaitre M, Bayard B and Lebleu B (1987) Specific Antiviral Activity of a Poly (L-Lysine)-Conjugated Oligodeoxyribonucleotide Sequence Complementary to Vesicular Stomatitis Virus N Protein mRNA Initiation Site. *Proc Natl Acad Sci USA* 84: pp 648-652.

Letsinger R L, Zhang G R, Sun D K, Ikeuchi T and Sarin P S (1989) Cholesteryl-Conjugated Oligonucleotides: Synthesis, Properties, and Activity As Inhibitors of Replication of Human Immunodeficiency Virus in Cell Culture. *Proc Natl Acad Sci USA* 86: pp 6553-6556.

Liu A Y, Robinson R R, Hellstrom K E, Murray E D, Jr., Chang C P and Hellstrom I (1987a) Chimeric Mouse-Human IgG1 Antibody That Can Mediate Lysis of Cancer Cells. *Proc Natl Acad Sci USA* 84: pp 3439-3443.

Liu A Y, Robinson R R, Murray E D, Jr., Ledbetter J A, Hellstrom I and Hellstrom K E (1987b) Production of a Mouse-Human Chimeric Monoclonal Antibody to CD20 With Potent Fc-Dependent Biologic Activity. *J Immunol* 139: pp 3521-3526.

Liu N, Sawyer S L, Mukherjee N, Pakstis A J, Kidd J R, Kidd K K, Brookes A J and Zhao H (2004) Haplotype Block Structures Show Significant Variation Among Populations. *Genet Epidemiol* 27: pp 385-400.

Lonberg N and Huszar D (1995) Human Antibodies From Transgenic Mice. *Int Rev Immunol* 13: pp 65-93.

Lynch H T and de La C A (2003) Hereditary Colorectal Cancer. *N Engl J Med* 348: pp 919-932.

Madura K, Dohmen R J and Varshavsky A (1993) N-Recognin/Ubc2 Interactions in the N-End Rule Pathway. *J Biol Chem* 268: pp 12046-12054.

Maher L J, III (1992) DNA Triple-Helix Formation: an Approach to Artificial Gene Repressors? *Bioessays* 14: pp 807-815.

Malik F, Delgado C, Knusli C, Irvine A E, Fisher D and Francis G E (1992) Polyethylene Glycol (PEG)-Modified Granulocyte-Macrophage Colony-Stimulating Factor (GM-CSF) With Conserved Biological Activity. *Exp Hematol* 20: pp 1028-1035.

Marasco W A, Haseltine W A and Chen S Y (1993) Design, Intracellular Expression, and Activity of a Human Anti-Human Immunodeficiency Virus Type 1 Gp120 Single-Chain Antibody. *Proc Natl Acad Sci USA* 90: pp 7889-7893.

McConnell H M, Owicki J C, Parce J W, Miller D L, Baxter G T, Wada H G and Pitchford S (1992) The Cytosensor Microphysiometer: Biological Applications of Silicon Technology. *Science* 257: pp 1906-1912.

Morrison S L (1985) Transfectomas Provide Novel Chimeric Antibodies. *Science* 229: pp 1202-1207.

Myers R M, Larin Z and Maniatis T (1985) Detection of Single Base Substitutions by Ribonuclease Cleavage at Mismatches in RNA:DNA Duplexes. *Science* 230: pp 1242-1246.

Nishimura Y, Yokoyama M, Araki K, Ueda R, Kudo A and Watanabe T (1987) Recombinant Human-Mouse Chimeric Monoclonal Antibody Specific for Common Acute Lymphocytic Leukemia Antigen. *Cancer Res* 47: pp 999-1005.

Osborne S E, Matsumura I and Ellington A D (1997) Aptamers As Therapeutic and Diagnostic Reagents Problems and Prospects. *Curr Opin Chem Biol* 1: pp 5-9.

Patel D J (1997) Structural Analysis of Nucleic Acid Aptamers. *Curr Opin Chem Biol* 1: pp 32-46.

Perry-O'Keefe H, Yao X W, Coull J M, Fuchs M and Egholm M (1996) Peptide Nucleic Acid Pre-Gel Hybridization: an Alternative to Southern Hybridization. *Proc Natl Acad Sci USA* 93: pp 14670-14675.

Pinkert C A, Ornitz D M, Brinster R L and Palmiter R D (1987) An Albumin Enhancer Located 10 Kb Upstream Functions Along With Its Promoter to Direct Efficient, Liver-Specific Expression in Transgenic Mice. *Genes Dev* 1: pp 268-276.

Queen C and Baltimore D (1983) Immunoglobulin Gene Transcription Is Activated by Downstream Sequence Elements. *Cell* 33: pp 741-748.

Reich D E, Cargill M, Bolk S, Ireland J, Sabeti P C, Richter D J, Layery T, Kouyoumjian R, Farhadian S F, Ward R and Lander E S (2001) Linkage Disequilibrium in the Human Genome. *Nature* 411: pp 199-204.

Reiter Y and Pastan 1 (1996) Antibody Engineering of Recombinant Fv Immunotoxins for Improved Targeting of Cancer: Disulfide-Stabilized Fv Immunotoxins. *Clin Cancer Res* 2: pp 245-252.

Rioux J D, Daly M J, Silverberg M S, Lindblad K, Steinhart H, Cohen Z, Delmonte T, Kocher K, Miller K, Guschwan S, Kulbokas E J, O'Leary S, Winchester E, Dewar K, Green T, Stone V, Chow C, Cohen A, Langelier D, Lapointe G, Gaudet D, Faith J, Branco N, Bull S B, McLeod R S, Griffiths A M, Bitton A, Greenberg G R, Lander E S, Siminovitch K A and Hudson T J (2001) Genetic Variation in the 5q31 Cytokine Gene Cluster Confers Susceptibility to Crohn Disease. *Nat Genet* 29: pp 223-228.

Rivas G and Minton A P (1993) New Developments in the Study of Biomolecular Associations Via Sedimentation Equilibrium. *Trends Biochem Sci* 18: pp 284-287.

Sachidanandam R, Weissman D, Schmidt S C, Kakol J M, Stein L D, Marth G, Sherry S, Mullikin J C, Mortimore B J, Willey D L, Hunt S E, Cole C G, Coggill P C, Rice C M, Ning Z, Rogers J, Bentley D R, Kwok P Y, Mardis E R, Yeh R T, Schultz B, Cook L, Davenport R, Dante M, Fulton L, Hillier L, Waterston R H, McPherson J D, Gilman B, Schaffner S, Van Etten W J, Reich D, Higgins J, Daly M J, Blumenstiel B, Baldwin J, Stange-Thomann N, Zody M C, Linton L, Lander E S and Altshuler D (2001) A Map of Human Genome Sequence Variation Containing 1.42 Million Single Nucleotide Polymorphisms. *Nature* 409: pp 928-933.

Saiki R K, Bugawan T L, Horn G T, Mullis K B and Erlich H A (1986) Analysis of Enzymatically Amplified Beta-Globin and HLA-DQ Alpha DNA With Allele-Specific Oligonucleotide Probes. *Nature* 324: pp 163-166.

Sasieni D P (1997) From Genotypes to Genes: Doubling the Sample Size. *Biometrics* V. 53, (4) 1253-1261.

Scott J K and Smith G P (1990) Searching for Peptide Ligands With an Epitope Library. *Science* 249: pp 386-390.

Shaw D R, Khazaeli M B and LoBuglio A F (1988) Mouse/Human Chimeric Antibodies to a Tumor-Associated Antigen: Biologic Activity of the Four Human IgG Subclasses. *J Natl Cancer Inst* 80: pp 1553-1559.

Sjolander S and Urbaniczky C (1991) Integrated Fluid Handling System for Biomolecular Interaction Analysis. *Anal Chem* 63: pp 2338-2345. Smith & Johnson (1988) Single-step purification of polypeptides expressed in *Escherichia coli* as fusions with glutathione S-transferase. *Gene* 67: 31-40.

Sun L K, Curtis P, Rakowicz-Szulczynska E, Ghrayeb J, Chang N, Morrison S L and Koprowski H (1987) Chimeric Antibody With Human Constant Regions and Mouse Variable Regions Directed Against Carcinoma-Associated Antigen 17-1A. *Proc Natl Acad Sci USA* 84: pp 214-218.

Szabo A, Stolz L and Granzow R (1995) Surface Plasmon Resonance and Its Use in Biomolecular Interaction Analysis (BIA). *Curr Opin Struct Biol* 5: pp 699-705.

Taillon-Miller P, Piernot E E and Kwok P Y (1999) Efficient Approach to Unique Single-Nucleotide Polymorphism Discovery. *Genome Res* 9: pp 499-505.

van der Krol A R, Mol J N and Stuitje A R (1988) Modulation of Eukaryotic Gene Expression by Complementary RNA or DNA Sequences. *Biotechniques* 6: pp 958-976.

Verhoeyen M, Milstein C and Winter G (1988) Reshaping Human Antibodies: Grafting an Antilysozyme Activity. *Science* 239: pp 1534-1536.

Vlatakis G, Andersson L I, Muller R and Mosbach K (1993) Drug Assay Using Antibody Mimics Made by Molecular Imprinting. *Nature* 361: pp 645-647.

Wada K, Wada Y, Ishibashi F, Gojobori T and Ikemura T (1992) Codon Usage Tabulated From the GenBank Genetic Sequence Data. *Nucleic Acids Res* 20 Suppl:2111-8: pp 2111-2118.

Wang D G, Fan J B, Siao C J, Berno A, Young P, Sapolsky R, Ghandour G, Perkins N, Winchester E, Spencer J, Kruglyak L, Stein L, Hsie L, Topaloglou T, Hubbell E, Robinson E, Mittmann M, Morris M S, Shen N, Kilburn D, Rioux J, Nusbaum C, Rozen S, Hudson T J, Lipshutz R, Chee M and Lander E S (1998) Large-Scale Identification, Mapping, and Genotyping of Single-Nucleotide Polymorphisms in the Human Genome. *Science* 280: pp 1077-1082.

Winoto A and Baltimore D (1989) A Novel, Inducible and T Cell-Specific Enhancer Located at the 3' End of the T Cell Receptor Alpha Locus. *EMBO J* 8: pp 729-733.

Wood C R, Boss M A, Kenten J H, Calvert J E, Roberts N A and Emtage J S (1985) The Synthesis and in Vivo Assembly of Functional Antibodies in Yeast. *Nature* 314: pp 446-449.

Zervos A S, Gyuris J and Brent R (1993) Mxi1, a Protein That Specifically Interacts With Max to Bind Myc-Max Recognition Sites. *Cell* 72: pp 223-232.

Zon G (1988) Oligonucleotide Analogues As Potential Chemotherapeutic Agents. *Pharm Res* 5: pp 539-549.

Zuckermann R N, Martin E J, Spellmeyer D C, Stauber G B, Shoemaker K R, Kerr J M, Figliozzi G M, Goff D A, Siani M A, Simon R J and. (1994) Discovery of Nanomolar Ligands for 7-Transmembrane G-Protein-Coupled Receptors From a Diverse N-(Substituted)Glycine Peptoid Library. *J Med Chem* 37: pp 2678-2685.

SEQUENCE LISTING (1836 sequences)

SEQ ID NO: 1 - DNA, 661 bp, Homo sapiens
  LOC400745
  misc_feature [331]..[331]: Chromosome 1, SNP identification no. = rs951805
  misc_feature [331]..[331]: allele = a, in linkage disequilibrium with rs2320590, respectively
  misc_feature [331]..[331]: n is a, t, c or g
tctgtcgcccaggctggagcgacagtacagcaagggtttaagatagggtctgactctgtcgcccaggctggagtgacagtggcacaatcacaatcaatgctcactcctccatctctcaggctcaagtgatcctcctgtctcagccaccaagcagctgggactacaggtgcatgccaccacacccagctaatttttttgtttgttttttagtagaaacgaggtctcactatattgcctaggctgaagcaagggctctttgacttctagatgtaagtgctctgggcaacacttcaccacagccatctgccagccttgagtccagtgacaaganggaacaagatggtttacaagtcacccctattctctgcaaatccagtttattaaacttggagttcacaaagaataaacggttaattcctagctttcttgggtgggggcagggggagaaaagcgcgtaagttttaaatagaggactcgacaatttctagctccacagtccccgttttgagaatattcagagacagcaacacgaggcaagctccattaaatactaactctaacaagttttctgatgcatacaattcattctgatacatgcaatttttaaaatagtggcaggaatttgtttgaggtcaaaatgacaaaagcttaaattcagata

SEQ ID NO: 2 - DNA, 661 bp, Homo sapiens
  misc_feature [331]..[331]: Chromosome 1, SNP identification no. = rs710311
  misc_feature [331]..[331]: allele = c, in linkage disequilibrium with rs2320590, respectively
  misc_feature [331]..[331]: n is a, t, c or g
gtcctttatggtactgtaccgtacacgtggttgtacaagtcgtcagtactgagggtgggggtggggtcgaacggaaaaacagtaggaagggacgagttatacccaggaacccaaaggacatgtgtattcagtaattaggtcaccaacttcaaaacgtggaccaccgagggttctcgcgaacacaacagtacttacactctagtgtctgtaaaccgtctacttcgtcactaccggcaaaatgcgacgttaggactcgccttgggtcctttaccgactatggctgacttcaaacaatgtaaactacatttgaaaagtcaaacatgtaccttanatggaaatacatggaaatcactccgatgtagacaccatgttcaaaccacaaagacgcgaaaatcctattctggttgacttaaaccattggaccccctcatcgggtctattcgtcaatgtaatgaaactacgtatttatttttactttcggcccgtgtcaccgagtacggatattagggtcgtgaaaccctccgactccgtccaccaagtgaacggcagtcctcaagttctggtcggacccggtagagatggtttttctacttttaatcggttcgcaccaccgcacgtgtacattatccgatgaaccctccgtctccgtcctcttaacgaa

SEQ ID NO: 3 - DNA, 661 bp, Homo sapiens
  misc_feature [331]..[331]: Chromosome 1, SNP identification no. = rs12123092
  misc_feature [331]..[331]: allele = a, in linkage disequilibrium with rs2320590, respectively
  misc_feature [331]..[331]: n is a, t, c or g
agtgttaatcgttatgactattactacttacattaataagccaaacttacaactatactttatgagacatactctaggcaccacagagttctcttttgctaagcaaagatttaatagtgaacagtgttaattatacattatatacaatatcaggaaaaaaaagagttgtaatttttgaggaaaatcgcttcagccttttgaggcctcctttgacataccagtggttgacaagacagaattaagaacagttaaaacagttaaaaagctgataaaattaaatcatcaaaggtagaaagttttccaacaggaaaaaagccactgaagttaacantcttgtggaaaagaacagaagaaagaatagggccaggtatggcgactcacgcctgtaatcctggcactttggaaagcccaggtgggaagatcacgtgaggccacgagttcaagaccagcctgggcaacacagtgaggccccatctctagaaaagataaattagccaggcatttattagcttgcctgtagtcctggctacttgggaggctgaggtggggagaactgcttgagcacacgagttcaaagctgcagtgagccaagatcacaccactgcgctgcagccttagtgacacagcaaactccatctcaaaaaaataataagtaaaagaa

SEQ ID NO: 4 - DNA, 661 bp, Homo sapiens
  HP1-BP74
  misc_feature [331]..[331]: Chromosome 1, SNP identification no. = rs12121807
  misc_feature [331]..[331]: allele = c, in linkage disequilibrium with rs2320590, respectively
  misc_feature [331]..[331]: n is a, t, c or g
ttctagaatttgatgtctaggatttatctgttatcttttgcagtactgtaattttttctagtccaaggacttatctgaatattgaacatttattgaacatgattgtactctatgatcttggaagcagtctttaataaaatacaaaatgattttttaaacctttgattcattaagtaattagcattcaatgtatctggaaacatcgtttaccctctataagaattccaaaacacatgaactggagcttgtatttaaaaaggaaaatgatggtgttcatttcaaggagtagaaaagacttaaagtgagggcgacacttagctacttctgaggntatactatactcaaaacctttaaatataagctacggttcagcagcttttaaaatttcatgtttattcatatttttcaaaatatatgtacattaaaaaaggaagatttacaacaggaaagattgccttacatgcaacacaaattccaatgaattcatgatgggatcacacatgattatgatctaattcaagccaatcttctcaagtccatttcccagccatactttaggctacagaagggatcccaggagacaaaagtggaatgaataagaaacaaacatcttttgcctctggcagtactcaaggggccagaagatgtacttcaaaaactt

SEQ ID NO: 5 - DNA, 661 bp, Homo sapiens
  HP1-BP74
  misc_feature [331]..[331]: Chromosome 1, SNP identification no. = rs10916859
  misc_feature [331]..[331]: allele = g, in linkage disequilibrium with rs2320590, respectively
  misc_feature [331]..[331]: n is a, t, c or g
ctcccaggtttaagtgattctcttgccttggcctcttgagtagctggaactacaggcacgtgccaccatgcatggctaatttttttgtatttttagtagagatggggtttcaccatgttggccaggctggtctcgaactcctgacctcatgtgatccacctgcctcccaaagtgctgggattacaggcatgagccacagtacccagcctgtttactgatatattttaaagacagagcaaaaataattgcttatagattagataaaggtgtctgataaagagaagagaccagcacaaagtcagggtttttggtttcagcacatggaaggatnatattgtcatgaactgaaatgaagataatgtgggaaatgcagggatttttggggggagagggagcagagtggggatcattaaatgttttcaacatttaaatcagacatccaagtgctgatgctgaacaggcatccgtatacacgaatctgaagttagaagggaggtatgggctagattcatacatttgtgaattaatagtttatagctggtatttacagttttgcaagtgaaaggaatcaccaagtgaatgtggacataaaagatgagaggcctaaggtataaccctgagggctcctttctattaagaggtaaagcagaaatccttagga

SEQ ID NO: 6 - DNA, 661 bp, Homo sapiens
  HP1-BP74
  misc_feature [331]..[331]: Chromosome 1, SNP identification no. = rs7548269
  misc_feature [331]..[331]: allele = c, in linkage disequilibrium with rs2320590, respectively
  misc_feature [331]..[331]: n is a, t, c or g
tctttgtcttttatttacctatgacctagaagccccctccctgatttgagttgtcccacctttccagaccaaaccaacatacaccttacatatattaatgtctcatgtttccctaaaatgtgtaaaaccaagctgtgcccagaccaccctgggcacaagttttcagaacctcctgaggctgtgtcacgggcacaatcttaaccttggcaaaataaactttctaaattgactgagacctgtctcagatattttggggtcacacaaaggagataaaagtgaaatatgatccccagtgttgcaggtggggcctagtgggaggtgtctgagttanagggatggcttcgtgaatggcttcgtgccttcctggccgtaatgagcgggttgtttaaaacaactggttgttttaagagtgtgagatctggttaagagtgtggcacctttccctcctctcttgctcccttttttgccatgtgatacgatagctcctccttccaccatgattgtaagtttcctgaagccctcactagaagcagacgcctgcactatgcttcttgtacagcctgcagtaccatgagccaaataaactttattctttgttaaagaatagtgaaatatgtttccatctttaaatgcatcatataacgcatttttgatccacaat

SEQ ID NO: 7 - DNA, 661 bp, Homo sapiens
  HP1-BP74
  misc_feature [331]..[331]: Chromosome 1, SNP identification no. = rs7548649
  misc_feature [331]..[331]: allele = g, in linkage disequilibrium with rs2320590, respectively
  misc_feature [331]..[331]: n is a, t, c or g
aaatatgtttccatctttaaatgcatcatataacgcatttttgatccacaattgtgtctgcctactaccactatactcagcatataagaagcatgaaaatatcagcacattaatttagaactttctgcttctataattcccttttcttttgcactatttcactagctctttaatttggcattctgatgaccactactgattttctgaaaatgtggcttctggactgaaacctcagcacttctaattgcatgcctcagtaatgcaagtaaatactggtactacactgtatcgggacaatgtgcattcaatatggtagtcttctgtagacagnaatctggattaaacataattttctagaagtcatctcacacaaacactctcagagtctgtgaattacaaatttaaacaaattgatatatctgcatgaatctacaactgagcaaatgtgacaatctaaatgatctgtcaagacgttaaatggcaaattttacgtatcaattactaacaaaattatctcagaattttatgctgcatgtttaaatgatggaaacattatgctatttctatgtacaggtgttattgaagcctgaattctcatgaaatatatatatgatgtatatgtatgtacatatgtatgcatatatctatcatatatatgttt

SEQ ID NO: 8 - DNA, 661 bp, Homo sapiens
  HP1-BP74
  misc_feature [331]..[331]: Chromosome 1, SNP identification no. = rs3736880
  misc_feature [331]..[331]: allele = a, in linkage disequilibrium with rs2320590, respectively
  misc_feature [331]..[331]: n is a, t, c or g
tcttactactaacaattgtgtaatacctgtttgatgactcctctatttaattctcttttcagtgcttgtttaaggagataaccccttctctccagctccagagaaggatacttatggatgatgtattttcgaatagcaaccactgatgcaccactcttctggaagcatgcctagaaaagatttattaaactagttgtttttttttattagatagagcctgacatatattttcaaaataaattattttggaagtgaatttgatgatagatgacaaaaacggtagggaagaatgaacttcagaagacttcagttcataatgactacagagaantaacagaattactaaatatttctactacaattttaaattgttcaaaacagcctaagagaccatactgaacacgaacaacattctatgtataatgaagaacctctttccattttaattccattctgtatttagaagatgaatctttggcatcaaaatgagaaaagcagaacaaacctatcacttacaggatcacagatctgtcccattttaaggcacgagcttaaggaatgagcatgccaggacatttccctgaaggctctgtatgaatgtcagcagaaagaagaatcaaagataatctgaataagtggcataaaaatgggtttacagatg

SEQ ID NO: 9 - DNA, 661 bp, Homo sapiens
  HP1-BP74
  misc_feature [331]..[331]: Chromosome 1, SNP identification no. = rs651085
  misc_feature [331]..[331]: allele = a, in linkage disequilibrium with rs2320590, respectively
  misc_feature [331]..[331]: n is a, t, c or g
tttcagtgcttgtttaaggagataaccccttctctccagctccagagaaggatacttatggatgatgtattttcgaatagcaaccactgatgcaccactcttctggaagcatgcctagaaaagatttattaaactagttgtttttttttattagatagagcctgacatatattttcaaaataaattattttggaagtgaatttgatgatagatgacaaaaacggtagggaagaatgaacttcagaagacttcagttcataatgactacagagaagtaacagaattactaaatatttctactacaattttaaattgttcaaaacagcctaanagaccatactgaacacgaacaacattctatgtataatgaagaacctctttccattttaattccattctgtatttagaagatgaatctttggcatcaaaatgagaaaagcagaacaaacctatcacttacaggatcacagatctgtcccattttaaggcacgagcttaaggaatgagcatgccaggacatttccctgaaggctctgtatgaatgtcagcagaaagaagaatcaaagataatctgaataagtggcataaaaatgggtttacagatggcaaagtgctgaaggagagttttgggtaatagtgaaggtgttctatttgaatttaa

SEQ ID NO: 10 - DNA, 661 bp, Homo sapiens
  HP1-BP74
  misc_feature [331]..[331]: Chromosome 1, SNP identification no. = rs651538
  misc_feature [331]..[331]: allele = g, in linkage disequilibrium with rs2320590, respectively
  misc_feature [331]..[331]: n is a, t, c or g
ccactgatgcaccactcttctggaagcatgcctagaaaagatttattaaactagttgtttttttttattagatagagcctgacatatattttcaaaataaattattttggaagtgaatttgatgatagatgacaaaaacggtagggaagaatgaacttcagaagacttcagttcataatgactacagagaagtaacagaattactaaatatttctactacaattttaaattgttcaaaacagcctaagagaccatactgaacacgaacaacattctatgtataatgaagaacctctttccattttaattccattctgtatttagaagatgnatctttggcatcaaaatgagaaaagcagaacaaacctatcacttacaggatcacagatctgtcccattttaaggcacgagcttaaggaatgagcatgccaggacatttccctgaaggctctgtatgaatgtcagcagaaagaagaatcaaagataatctgaataagtggcataaaaatgggtttacagatggcaaagtgctgaaggagagttttgggtaatagtgaaggtgttctatttgaatttaatgtgccctcttccatttccatcctattttacttatactccatttgactaatgcacctggaagaattaagtagctcattatgtc

SEQ ID NO: 11 - DNA, 661 bp, Homo sapiens
  HP1-BP74
  misc_feature [331]..[331]: Chromosome 1, SNP identification no. = rs589755
  misc_feature [331]..[331]: allele = g, in linkage disequilibrium with rs2320590, respectively
  misc_feature [331]..[331]: n is a, t, c or g
aaaaattctcaatatttttcagttactgagtcacaattagatttataagggcaaggactttgctagccttagttaattcaccactagcaggggcgcccaacagaggaaggtagtccttaaatgtttgttcaatgaattaacattttcagccttcaaataaaaactgtacttaatcgataaactgcatttaaaaattctaaagttaaaatatttgctatattaaatataatttttttaaaaaaattaacagtgttcaccaaatgtgattatattagaaaaacatgaacttataatgactttcctctctttaaaactcctttaggaagcagancaagatttatgatgtctagacagatatatgccattttcaaataagaaaaaaatgaacataataaatctaagatgaattgcttgaaataaaaacttgccttaatggcctcagttaagattgcatccatcttgggacgtggggaagaagccatcggtgtttgtttctgggccctggctagctggctggcagaaagggtagcccaggaaggaattgtttttttcactttcttctccttttctttagactgatctttctcactttaaaacaaagaattgttattatagaagataagctctctagaaagacgtataaagtcagaaggaggaaaag

SEQ ID NO: 12 - DNA, 661 bp, Homo sapiens
  HP1-BP74
  misc_feature [331]..[331]: Chromosome 1, SNP identification no. = rs1021077
  misc_feature [331]..[331]: allele = c, in linkage disequilibrium with rs2320590, respectively
  misc_feature [331]..[331]: n is a, t, c or g
agagaaaggaaaaaagggaaaagataaggaaaaaaaccaaaaagatcatgagaagaaaaataaagacgggaaaaggagaagaggtggttatacatgccataaaggagcattagtactccatgttgatgggtctatgtttctttccatttgttatgctcccaccactgactggccaatcttctctctaccaatacctgttatagatcaacagatcaccatttgcttctctgaaggcctccagatgatttctggatgaaccttccactgtctattctaaaggcccacgttttccattctcccacactgcactgatccccatgacactttatgnccagaatgctactctctggccattcctgtcatccccaaacatttttgtttttaattccaacataacattttcaccttccaaaaacctttatagagaagatgaaaccttactttgccctcatggtctggcaatgacataccaatagctactgattctctctaaatgtttccccaaaacacttagccatgaaaaaaaaaaaaaaacaattaagttcaaaggaatttatgggacactccaaattgcagtataacttttgatgttttaagctgtgtcaccattttactttacctggcttttcttcctccccttcagcaagcttgcttttgggag

SEQ ID NO: 13 - DNA, 661 bp, Homo sapiens
  misc_feature [331]..[331]: Chromosome 1, SNP identification no. = rs12123093
  misc_feature [331]..[331]: allele = t, in linkage disequilibrium with rs2320590, respectively
  misc_feature [331]..[331]: n is a, t, c or g
agcggggctagcctttcccgcttctcagtttaggcgcagctcaagagcaaacctttttttgaagaccgtagaattggaaaactagagagcggagaattcactgcctcgcactcgctcccattaagtctccagacggtacagggcagagtagtgactcgggactcagaactgaaaagttgaaacgggctttccgggctccctaatcctcacatgcagggagagttccccagaatgaaaaccctgagattagaagacgggattccctttgaattgtcatattgcgttgctatcagcgtacttaaacaacgtacatacgaaggaaaagtacagntcttcaaagctagtttggaaagattgtttttaaagtttcaggtgttgggggacaggggagggactgggtaataaatgtaaggaaataccagtagaattgtcccaagcttacagtagatgaccagtactcaaacgtatgtgccaaggtttataaagacttacgacaccatttaagcactcacccagtcgtctggccctgccattagcataattgtctcaccagctttccctgccacagccaccccactctatcagttcaaatttcacagccagcataaaaaattctttacgaggtgtgcgttatcattcatatcctgatggcattaccagt

SEQ ID NO: 14 - DNA, 661 bp, Homo sapiens
  misc_feature [331]..[331]: Chromosome 1, SNP identification no. = rs3856173
  misc_feature [331]..[331]: allele = a, in linkage disequilibrium with rs2320590, respectively
  misc_feature [331]..[331]: n is a, t, c or g
accagtagaattgtcccaagcttacagtagatgaccagtactcaaacgtatgtgccaaggtttataaagacttacgacaccatttaagcactcacccagtcgtctggccctgccattagcataattgtctcaccagctttccctgccacagccaccccactctatcagttcaaatttcacagccagcataaaaaattctttacgaggtgtgcgttatcattcatatcctgatggcattaccagtctttagtactctggtgtcatattccagctgttcagaaggggttttgctcttttatgccattcttcattctgctcactcccttcgttnttaacgtttctgttgtcttccttttcaaagacttccatttttatgtattcgtacatttaaaacatcctaccgttcttcttttaccctaaaatgtctttagacccatctcatgtaagaagcagactcagatgagagcaaactgggagatgtttcctcctccacagatttttgcttaaaacaacaacaacaaaacttaggccgagcatggtggtttacgcctgtagtccctgcactttgggaggccgaggtgggaggattgcatgaggcttggggccaggagttcgaggccagccagggcaacataattagaccccatctctaaataaataa

SEQ ID NO: 15 - DNA, 661 bp, Homo sapiens
  misc_feature [331]..[331]: Chromosome 1, SNP identification no. = rs4233274
  misc_feature [331]..[331]: allele = t, in linkage disequilibrium with rs2320590, respectively
  misc_feature [331]..[331]: n is a, t, c or g
cagcctgggtgacagaaggagactccacctcaaaaataaataaataaataaataattagctgggcatggtggtgcacgcctgtagtcctggctactcgggaggctgaggcaggagaatcgctttaacctgggaggcggaggttgcaatgagcagagatcccaccactgcactccagcctgggcgacagagcaagactccgtctcaaaagaacaaaaaaacaaccagtaatttaaaggaaaacatgagtcaaaatctgtggttgggaataagattgaattttaaaaatcagaatcacgaaattggatccatttatttaaaaaataaagagangaaaagagttttaaaaagatggtgatgaaaaggatcatttccttttataaatcaaaacgcaactgcatggtgatgagaaaatgcaaacttttcaaaaaccaatacatactggctctgagttttgttttttttgagacggcgtctcgctctcttgccaggctggagtgtagtggcgagatctcggctcattgtaacctccacctcccgggttcaagggattctcctgcctcagcctcctgagtagctggaactacaggcacacgccaccacgcccacctaatttttgtatttctagtagagacagggtttcaccatgttggccaggatggt

SEQ ID NO: 16 - DNA, 661 bp, Homo sapiens
  misc_feature [331]..[331]: Chromosome 1, SNP identification no. = rs1152999
  misc_feature [331]..[331]: allele = t, in linkage disequilibrium with rs2320590, respectively
  misc_feature [331]..[331]: n is a, t, c or g
gcttgtttggtatagctgtctctttgcccaaagtagttggcatcccctaaattaggaacaaagccagagctggatgtgacagaacatgcatttctaagtacctggtatttttaggagttcattatgattttgtaggaaaatagtcattttctttctaggtagggcaataaacaacttgaaaaggacactaagcattgatccttgtgttaaaaaaaaaaaaaaaaggattttgcaatgttctattgaatcccaggagaagtgggagctaaaagcctctattcccaggtctgttagcagtagggatagacacttaagacttcatagtattgcngggcacggtggttcacgcctgtaatcccagcactttgggaggccaaggcgggcagatcacgaggtcagaagattgagaccatcctggctaacatgataggtaaaaccccatctctactaaaaatacaaaaaaattagccgggtatggtggcgggcgtctgtagtcccagctactcggaaggctgaggcgggagaatggcgtgaacctgggaggcggagcttgcagtgagccgagatggtgccactgaattccagcctgggcaacagagcgagactccgtctcaaaaaaaaaaaaaaaaaaagacttcatagtattttctagggaaagtaa

SEQ ID NO: 17 - DNA, 661 bp, Homo sapiens
  misc_feature [331]..[331]: Chromosome 1, SNP identification no. = rs1152998
  misc_feature [331]..[331]: allele = t, in linkage disequilibrium with rs2320590, respectively
  misc_feature [331]..[331]: n is a, t, c or g
taactcatgcctgcgaccccagcactttgggaggctaaggtgggttgatggcttgagctcaggtgttcaaaaccagcctgggcaacatggtgaaaacccatctctacaaaaaatacaagaattagccacagtcccagctactctggaggctcccttgagcccaggagacaggttgcaatgagccgagatcacagcactaagctactgcctgggcgacagtgagaccctgtctcataaaaaaataaataaataaatggaagccgaggtttcagcaaccccagcagggctatactaatgctcctatttttccaatgccaatattccaaactanatccactacgtcattttccccaaaagaaaactcttggtggtgagagttatttttcggacaatactgcctcccagaaaaccaagtgccagtcttgcttctgacacttgctaggtacatgacttctgtgttactcagttccctacctggtaaaaggaagcagcaccaccttacatgtcagaagcctagtatgaagaccaattagatgccatcctgcattgcctaggaaattaatttactattagtttactaaggaaatcaggaagggcttattgtttctgtgttgtagatgcgaaagtacaagccgaaaggttctaaaagcagcatacaact

SEQ ID NO: 18 - DNA, 661 bp, Homo sapiens
  misc_feature [331]..[331]: Chromosome 1, SNP identification no. = rs3125161
  misc_feature [331]..[331]: allele = a, in linkage disequilibrium with rs2320590, respectively
  misc_feature [331]..[331]: n is a, t, c or g
tccaatgtcactcgaaactaacacggtgacgtgaggtcggacccactgttctcaattctgggacagagaatttcgttttttcgactcattatgaaaatccatttacatttcagaaatttatgtaaacaaatctttggtatggtcaaatttcatttacttaatcccatagtcttcttggttgacccccgtccccctacggtggattcacttatagttctcaaatgagaaggaagatatccttcttcaacacacgactctccttcctccatatctgatcttaaccctctagacacgagattacgattgtaacgacaagtgccttataaactgntggacgaaccatacccggaaggagagaagagatctttcccgaatgagaacggttggtatactcgtgtaggtcttagtgaaatttatgacggatggttcgaattgtttctgttttccaaaaccattattatcctataatggtcgaaaagttacttcatttttatagttcttaaagactttaaagttcagtggtactcaacttgaacatgatagtcataaggaaaagttaggaagacagtataaatggagaataaccatttatgtacaggagactggacttcaggaccctttgatagaaacggtttaaagtttttcggtgggacggtatcga

SEQ ID NO: 19 - DNA, 661 bp, Homo sapiens
  misc_feature [331]..[331]: Chromosome 1, SNP identification no. = rs3121071
  misc_feature [331]..[331]: allele = c, in linkage disequilibrium with rs2320590, respectively
  misc_feature [331]..[331]: n is a, t, c or g
attcttgtagaaatggctgattctaggactgaggcagggaaaatacaagatatgtctgtggcatcttgtgatggcagaaagtacgtgctctaaaaacaaaagtatcagggaatgtcaagggacacataagccaacttgaaagagcccctaatggctaaagctggaacaatgtgaacaacaaaatcatgtactattgggttataattcaaagtatgaaatatacatgagcccatactgatatatacatacccatgtgtgtacatttatacatacacacatataaatacatatgagtgactaaacaaacaaatagagaagagagacatcttcnttgtgggaaaattccaaataatttaagtagacgcttcccactctagaaaggaagtaaagcttaattctctcttactcccatctctcttcccaagtgtgggttggatttagtgactggctttcatatagactagagtaagaaaggggggaaagaaaagtaactatagagaaacctggcaaacaccaacttagccaaataaagttatcatgtgagtatcttgtacctgctgatatatgagaagagaacttcatttatatggtatttgtgtttttattttttagagacagggtctcattctgctgcccaagctgaaatgcagtggcatgatca

SEQ ID NO: 20 - DNA, 661 bp, Homo sapiens
  EIF4G3
  misc_feature [331]..[331]: Chromosome 1, SNP identification no. = rs7520481
  misc_feature [331]..[331]: allele = t, in linkage disequilibrium with rs2320590, respectively
  misc_feature [331]..[331]: n is a, t, c or g
ttgtcttgagaaaacaaaaaacaggccaggtgcagtggctcatgcctgtaatcccagcactttgggaggctgaagaggatggatcacctgaggtcaggagttcgagaccaatctggccaacatggtgaaaccgtgtctctactaaaaacacaaaaatcagctgggtatggtggcaggcagaggctgaggcaggagaatcgtttgaacctgggaggtggaggctgcagtgagccaagattgcaccactgcactccagactgggcgacaagtgcaaaactccatctcaaaacaaaaaacaaaaaacaaaaaaagatacccttgcgtatcaganaaatgatctcttgaacatcaggactgatctggcactaagaacagatgagtcactgttttttttttttttttttttttgagactttgcactgtcacccgggctggagtgcagtggtgcgatctcagctcactgcaacctctgcctcccaggttcaagcgattctcctgcctcagcctcctgagtagctgggactacaggatccctgcctcagcctcccgagtagctgggactactcagctaattttttagtacttttagtagagatggggtttcactatgttggccaggctagtctcaaactctgacctcgtgatctgcctacctcagcct

SEQ ID NO: 21 - DNA, 661 bp, Homo sapiens
  EIF4G3
  misc_feature [331]..[331]: Chromosome 1, SNP identification no. = rs935918
  misc_feature [331]..[331]: allele = t, in linkage disequilibrium with rs2320590, respectively
  misc_feature [331]..[331]: n is a, t, c or g
gttttctcgttctgggacagatttatttatttatttatttatttatttatttatactctgaagtcaaattttctttttttttcgttagcctccagttccgacgtcactcggaactatcacggtgacgtgacattggactcgctttctcgttctgggacagatttatttatttatactctgaagtcaaattttcttttttttccgttttattatatatatattattttacttatatatttttacaaatatcaaactttttactccaactttttatgaaccggacatagaactgaatgtcaaacgaatttgtcgaataccggaagtacaacangaaaaaacgtatataacctcgtagtacctaacctacatatcaattggttatgatttagtctttttaacattataactcggtacaaagattttagaatacctcgacccacgtcaccacgtgtgacatcagagtcgacgagccctccgactccgtcttcctagaaactcggggtctcaagttcaggttgaaccgttgtatcactctggggttcagtttttatttatttattattttggaataaccctttatattaaatctctacgatgcattcaccatctttgccttgttagtctactgtcttgagttctgacaccaaaagtgaaacaccta

SEQ ID NO: 22 - DNA, 661 bp, Homo sapiens
  EIF4G3
  misc_feature [331]..[331]: Chromosome 1, SNP identification no. = rs10753507
  misc_feature [331]..[331]: allele = t, in linkage disequilibrium with rs2320590, respectively
  misc_feature [331]..[331]: n is a, t, c or g
cagctgcttaagattaaataattgatttatgaggtgactaatctggggagctacagctggttatttgggatttataaacatcaaaaaaagtccaatacacagagtttataaattccacactgtgtcttttcctagatagctctgtatgtatctgctattaaagccattcaagaagcctcactagaatccctcttcataatagatcacagccatgctgcctgatacaaggaggcttaaagcagttgttgctcctgaaccaggaatgagaagtgtttcaagggcaagaagcacaaggttgagcccaagagagagaataaagaagagctgttgncaggtagaaaaaagtgaagaggtacaagtcctctacctgaagaaagttacagtgacaacggaaaatgccaggtttgaggctgttgctgtcatctgagaggtatgtattaattacttcatagagtaacttgtccaaggcatagctgaaaatatagttgaaccagaatttgaactcggccatctggctccaaagcttatactatatgagaatttagttttatttggaagtagggttgtgctgtttctacacatcaaagttaataagaatgtgagtttttagttattattattaatttttgagacagagtctctctctgtagctcaggttgaa

SEQ ID NO: 23 - DNA, 661 bp, Homo sapiens
  EIF4G3
  misc_feature [331]..[331]: Chromosome 1, SNP identification no. = rs4654873
  misc_feature [331]..[331]: allele = a, in linkage disequilibrium with rs2320590, respectively
  misc_feature [331]..[331]: n is a, t, c or g
tgcttaagattaaataattgatttatgaggtgactaatctggggagctacagctggttatttgggatttataaacatcaaaaaaagtccaatacacagagtttataaattccacactgtgtcttttcctagatagctctgtatgtatctgctattaaagccattcaagaagcctcactagaatccctcttcataatagatcacagccatgctgcctgatacaaggaggcttaaagcagttgttgctcctgaaccaggaatgagaagtgtttcaagggcaagaagcacaaggttgagcccaagagagagaataaagaagagctgttgtcagntagaaaaaagtgaagaggtacaagtcctctacctgaagaaagttacagtgacaacggaaaatgccaggtttgaggctgttgctgtcatctgagaggtatgtattaattacttcatagagtaacttgtccaaggcatagctgaaaatatagttgaaccagaatttgaactcggccatctggctccaaagcttatactatatgagaatttagttttatttggaagtagggttgtgctgtttctacacatcaaagttaataagaatgtgagtttttagttattattattaatttttgagacagagtctctctctgtagctcaggttgaaatgc

SEQ ID NO: 24 - DNA, 661 bp, Homo sapiens
  EIF4G3
  misc_feature [331]..[331]: Chromosome 1, SNP identification no. = rs10799665
  misc_feature [331]..[331]: allele = a, in linkage disequilibrium with rs2320590, respectively
  misc_feature [331]..[331]: n is a, t, c or g
gaatgagaagtgtttcaagggcaagaagcacaaggttgagcccaagagagagaataaagaagagctgttgtcaggtagaaaaaagtgaagaggtacaagtcctctacctgaagaaagttacagtgacaacggaaaatgccaggtttgaggctgttgctgtcatctgagaggtatgtattaattacttcatagagtaacttgtccaaggcatagctgaaaatatagttgaaccagaatttgaactcggccatctggctccaaagcttatactatatgagaatttagttttatttggaagtagggttgtgctgtttctacacatcaaagttantaagaatgtgagtttttagttattattattaatttttgagacagagtctctctctgtagctcaggttgaaatgcagtggcacaatcttggctcactccaacctccacctcccagattcaagcgattctcctgcctcagcctcccaagtagctgggattacaggtgcctgtcaccatgcctggctaatttttgtatttttagtagagatgggattttgccatgttggccagactggtctccaactcctgacctcaagtgatccacccgcctcggcctcccaaagtgctgggattacaggcgtgagccactgtgccagccagaatgtgagtc

SEQ ID NO: 25 - DNA, 661 bp, Homo sapiens
  EIF4G3
  misc_feature [331]..[331]: Chromosome 1, SNP identification no. = rs2320590
  misc_feature [331]..[331]: allele = c, t
  misc_feature [331]..[331]: n is a, t, c or g
tgaaattatggatgaaacagcaaaggggccaattttgtaacagtctaaatcagcatttaccaaactgtgttccataggatatctatactctaagtgaggcaatgctgaattaaacaaagctaactagtttttatttattgctttactataggactgtcataaactttaatatgctaagtatgttttgttaatctcaaagaaaagggacatgaccatgtgcaaagtttgactatataaacaacttttgtggaaacactagtgtttcgaagaacagagtttgggaaccaccggtctatataacgtagcatccattccccactcacatccaaangtaggaatacttgagatctcagtttgttttattataatcatccttttattataatcatgagcatgtactatggggtaatgcagtctgacaagttacaatgggaaaatataactacttacagcactactgcaatgatagacacaaaagccagatgaacattaagcttctagaagcagtcatcttccagttacacgattctggagccaatctatcatcgccactaccctcaacagaccacagggctatcatatccccagaatatctcaggtgtagacctagcataaggtaacatttttacactgaaatcagaagtcttaaagagtcacagcc

SEQ ID NO: 26 - DNA, 661 bp, Homo sapiens
  EIF4G3
  misc_feature [331]..[331]: Chromosome 1, SNP identification no. = rs4654874
  misc_feature [331]..[331]: allele = a, in linkage disequilibrium with rs2320590, respectively
  misc_feature [331]..[331]: n is a, t, c or g
agctaatggtttcaggcttttgtgctatgaattataaatatttctcaatgtcaagcaaatgggaattaaatataaaacttaggaaaatcaaatataaaataccagcactcttatgtaggctaaaaatcatagctgttcatttggaagtataaacaaacaactcaagactttgttaattatttccacatacaatatataataaagtacaaaagcaaatgaatttaactacaggagacatacacataattgcaagtcataaggaaagggaggaatgaattgaagagctaagagcaggtggtaattgtatgcatgccctttcagatctctacanttgtaaaacgtgtgcttttccactgcagttccaggttctagccaaagtatgccacccttttttcagaggcctacatctcactaaaacttttcacttaaaaagagctaccaccataggcagggtcaccattctgaagctgccacttcaaaacagtttgcagctcagccatattatctaactctgggcttcatgaatccttaattccaactttctgacctcacagcttgcaattatttgatgccgaggacggtgtctgtgctatggcaaatagatgtcaaataattgcaggttctctcattatgtgcatactttgggttcagttaatgtacc

SEQ ID NO: 27 - DNA, 661 bp, Homo sapiens
  EIF4G3
  misc_feature [331]..[331]: Chromosome 1, SNP identification no. = rs11805169
  misc_feature [331]..[331]: allele = a, in linkage disequilibrium with rs2320590, respectively
  misc_feature [331]..[331]: n is a, t, c or g
ataataaagtacaaaagcaaatgaatttaactacaggagacatacacataattgcaagtcataaggaaagggaggaatgaattgaagagctaagagcaggtggtaattgtatgcatgccctttcagatctctacaattgtaaaacgtgtgcttttccactgcagttccaggttctagccaaagtatgccacccttttttcagaggcctacatctcactaaaacttttcacttaaaaagagctaccaccataggcagggtcaccattctgaagctgccacttcaaaacagtttgcagctcagccatattatctaactctgggcttcatgaanccttaattccaactttctgacctcacagcttgcaattatttgatgccgaggacggtgtctgtgctatggcaaatagatgtcaaataattgcaggttctctcattatgtgcatactttgggttcagttaatgtaccactgatgaaatataatctagctggactccaggatttctaggttaaccacctgatcctgccaactcatgctctgtgggctagcagcataaattaagctgtttaatgggcccaagagacaactgtagccatgctggtctttcagcagtgtacctgctgctatttttatctcatatattttatctcattacaaataaa

SEQ ID NO: 28 - DNA, 661 bp, Homo sapiens
  EIF4G3
  misc_feature [331]..[331]: Chromosome 1, SNP identification no. = rs4654875
  misc_feature [331]..[331]: allele = a, in linkage disequilibrium with rs2320590, respectively
  misc_feature [331]..[331]: n is a, t, c or g
tttctgaggaatgtagcataatatctgggtaataagtaactatttataaatggatatcctcgtcactccaacagtattatttctaggaaattatagtttcaagtctgctgggaggaccatattcaatctgattgtgagggtgtacatacctttatttgctcttaccatttgcactggctagttactggactgaattggaggcttctcttttaaaactgggaaaccatcctggccttaaaaaccaataaccacagcaacttttgccaaagtgtcttactaactggttcaaatggccttaattcagagcaatctagcttattgctgaaagaanacttttttttttccccagacgtggtctcattctgtcacctaggctggagtgcagtggtgtgatcatggcttactgcagtctggacctcccaggtgcaatccttctgcctcaacctcccaagtagctgggactatagcggcacaccaccatgcctagctaatttttatatttttagtatagatggagtttcaccatgctgcccaggctggtcttaaactcctgggctcaagcaatcttcctgcctcagccttccaaagtgctagcattacaggtgtgagccaccatgcccagcctgaaagaaaacttcttttttgagagggagtcttgctc

SEQ ID NO: 29 - DNA, 661 bp, Homo sapiens
  EIF4G3
  misc_feature [331]..[331]: Chromosome 1, SNP identification no. = rs935917
  misc_feature [331]..[331]: allele = t, in linkage disequilibrium with rs2320590, respectively
  misc_feature [331]..[331]: n is a, t, c or g
ccaccagtgacaggcagataggcagaccttatcaaaccatccattgacaagaatcataatgaaaccaacctgaaatagactaaatcattaagaacaccaagttacataaccttctccatgaggctagagtgggcacacaagtgcttcctagccacaataaccatggtttattgaaagaatatggtttttaaatttaagacaatttttcagaattgttctcacaaagaaaagcttttttcctcaaagaacatttggggatcacatgtaaatgggctgctaaaggcctcagagtttccctgaggctaaggggtctctgttaccttacttacancatgatagagatctaacaataatattcagaaaaccaaaagataacctttatgccctagcacaatctataaaatgccatcacatcaaccaacatatcaatatattaattgcatcatatcaacatattacagtggatacaattttcatctatggaaaaaactaaatacttaaagaggtaagtactttgaaaattaactggtacccaagagcctagtaactgaataccactcttgaagaggatactgaccctttgaaaaagtcctgtttgctgagtttttctgactgtaccagctgatagagtaattggcccatgtgatccctggtgatctgg

SEQ ID NO: 30 - DNA, 661 bp, Homo sapiens
  EIF4G3
  misc_feature [331]..[331]: Chromosome 1, SNP identification no. = rs4654724
  misc_feature [331]..[331]: allele = t, in linkage disequilibrium with rs2320590, respectively
  misc_feature [331]..[331]: n is a, t, c or g
aaagttacaccaattgggagaagacacttcaatttgtctctgagatccatttagggactacagttaagagatacaatttatatagtgaaacaaattagaaagctatataaatactaaaaaactaaaactgctattacttcatgactaatatttaaaagaggctgaaaataatcttcaatttaaactgttttccattgctatattcgtcatcacaacatttaatactttttgaaaaccttgtatttatcacgtaatgttctaagtgtttacgtgtattaacttcttatttaattttcataatatcctgaaaaggtaggtacaacttatcccnatttaacagataaggaaactgaaacacaggttaaatacatgaagcaatttttagagcattatccgagcaagtcctctaagtatatacatgctaaatgcatacaaaaacaacaggttaccacggaagatgaagtcagctaaagataacctaataccttctctttggtttgtcttgcagtggctcaatgagaattttcacacatttgaggagctctacacagcatacacaatctaacagcaacgtcaagtgtgggatgttacagggacttgtaagaaattcagattgcttaaaatacagcaggaggacctcctcaccataacatttaataga

SEQ ID NO: 31 - DNA, 661 bp, Homo sapiens
  EIF4G3
  misc_feature [331]..[331]: Chromosome 1, SNP identification no. = rs2305463
  misc_feature [331]..[331]: allele = c, in linkage disequilibrium with rs2320590, respectively
  misc_feature [331]..[331]: n is a, t, c or g
cttccctcccatcccatcccaaattcaccacccaattatgttcctatcttagaaattatagtgtgtgaagattaaagaaatcaactttaggaataaaaggaatgcatccataaggattgctatcaaaacccttgttcttatcttgccacacatactggcaagcgggccagccttgagtagacataaaaagcagggttctcacctagttaaggtccttcgggaatcaaactctacaggcgtggatggcgtggaccctgagggtgctggaggttgcagggcagagaatctgtttaaactggaagcacttgaccgtaaggcatctacacatgtngaggatttagaaaaaaatacaaatcacatgactaaaatgcaaataatcagtcatctgcatccctaggtgaggcctgagaccaggcattcctaacaagcttaggtgacgcccatctcctggtccctctaccatattctgagaagcaaagtgttagagggaatttgcacataatagagtttagaagtctttatttatttcaaccattggttcctttaaaaacatagtaaacaggggtgggagtggcatataggaggaggaaggcaagcgaaaacagaacaaaactttaacaaagctaaccagcacaaatgctccaatctcatttgtgcacaa

SEQ ID NO: 32 - DNA, 661 bp, Homo sapiens
  EIF4G3
  misc_feature [331]..[331]: Chromosome 1, SNP identification no. = rs7543140
  misc_feature [331]..[331]: allele = g, in linkage disequilibrium with rs2320590, respectively
  misc_feature [331]..[331]: n is a, t, c or g
gattaaagaaatcaactttaggaataaaaggaatgcatccataaggattgctatcaaaacccttgttcttatcttgccacacatactggcaagcgggccagccttgagtagacataaaaagcagggttctcacctagttaaggtccttcgggaatcaaactctacaggcgtggatggcgtggaccctgagggtgctggaggttgcagggcagagaatctgtttaaactggaagcacttgaccgtaaggcatctacacatgtcgaggatttagaaaaaaatacaaatcacatgactaaaatgcaaataatcagtcatctgcatccctaggtnaggcctgagaccaggcattcctaacaagcttaggtgacgcccatctcctggtccctctaccatattctgagaagcaaagtgttagagggaatttgcacataatagagtttagaagtctttatttatttcaaccattggttcctttaaaaacatagtaaacaggggtgggagtggcatataggaggaggaaggcaagcgaaaacagaacaaaactttaacaaagctaaccagcacaaatgctccaatctcatttgtgcacaaatatgcatgtgggttttactgaataatgacattttttaaaatttaaagaaaaaaaggttgaaattactt

SEQ ID NO: 33 - DNA, 661 bp, Homo sapiens
  EIF4G3
  misc_feature [331]..[331]: Chromosome 1, SNP identification no. = rs1530946
  misc_feature [331]..[331]: allele = a, in linkage disequilibrium with rs2320590, respectively
  misc_feature [331]..[331]: n is a, t, c or g
tctatggtctgacagctcataatatatatgttgctatgctatgtaatatgctttcacacaaaccactcccaattaacaataaatatgtataacggttttgttctaggatacccatgtatagtacctccagtataactatctgaatacacaaagtttattagcaatttacatacttaaaaatattaaggtagtaatgttggaggtttgataccagcactgtttttatagtatccaagcacggaaagcataatatttaaaaatacaaatgttgttattaaataccgacacatttttcaaaatgctggaggacttctttaaacataaacttttngttaaaactgtctctagatggaaatggagatgggtaagactcaaattgtattcagcaatggaattcctactctgagatataaacaactagaagaaagtaccagaatcttggagaaaaggatcctagctaattacattattaagagagattcagaaggagaattttctatcatgaagcaaagctttgacaaaactgtgaagatgcaaatgacatagcccattttattccaattttcttaaagacttttcttaatacttcttgtcagttatcttctttcatgtagtattttcacattagttttgattgtcttcagtattttgctagcagggt

SEQ ID NO: 34 - DNA, 661 bp, Homo sapiens
  EIF4G3
  misc_feature [331]..[331]: Chromosome 1, SNP identification no. = rs4654880
  misc_feature [331]..[331]: allele = c, in linkage disequilibrium with rs2320590, respectively
  misc_feature [331]..[331]: n is a, t, c or g
gtttcatcatgttggtcaggctggtctcaaactcctgacctcaattgatccacccacctcagcctcccgaagtgctgggattacaggcatgagccactgcgtccggcctgctacaaagtgcccctttcttaaataaagttttctttcagctttctgtctctcttctttttctctaaattttaacagttaatggagaacacatttcataattgatatactatcttccatttgcttaacaaatgttcctcttttgcttgtcaaaagttttaccttaccagataaactgtacactttgagagggaagtaactacattttccacttccttttctngtctcaccaattctgagtatatagaagatgctcaataaagtcttattgcttactggcttttaagtagtgaaagaaatcatgctttgttcctgcattctctacttttactcagtaactttactcttcaggtgaaactgcttcacctaacaatcaccactctattctttgggctgttctttctgatctcattttatacctaaatacataattcttaatatgtattcctgaaacttccaagttctctaaaccctggtggattccggcctcacctggtcttctcttctctttggtcatgagttgctggaccttcctttgctcttcttgttcttc

SEQ ID NO: 35 - DNA, 661 bp, Homo sapiens
  EIF4G3
  misc_feature [331]..[331]: Chromosome 1, SNP identification no. = rs10916885
  misc_feature [331]..[331]: allele = a, in linkage disequilibrium with rs2320590, respectively
  misc_feature [331]..[331]: n is a, t, c or g
agaagaatcatctgaacctgggaggcggaggctgcagtgagccgagattgagccactgcactccagcctgggcgacagagtgagactctatctcaaaaaaaaaaacaaagcgcaaacaaaattgcaatatggtttgataatcagaataaggagaagaagcacgtaactggcaataggccttttgtcccttctcagaactctcccacggaaagtttgccaatccaaattctgagtcctgaagcaaaagcactatctttacacatgtaaacaacaggacatccttccccaacccaattcctttaaagagactggaccagcaggcttattattnttttttttcccactcaccagccttaggtctataacatcttgaagcatgaaccgaatcctagatgaggtttttctttctttcacaattttctccatctgattaaagtactggtccatacgtggctgcaagagacaaaatcattagtactcctgtctgagaaacttaaacgtaattttaccaatttacagttatttatttatgtagttatctatttatttttttagagatggggtttcactccgttgcccaggctggagtgcagtagcacaatcacggctcactgcagcttcaacctctcaggctcaaccgatcccacctcagcctctcgag

SEQ ID NO: 36 - DNA, 661 bp, Homo sapiens
  EIF4G3
  misc_feature [331]..[331]: Chromosome 1, SNP identification no. = rs6695218
  misc_feature [331]..[331]: allele = a, in linkage disequilibrium with rs2320590, respectively
  misc_feature [331]..[331]: n is a, t, c or g
ccgcctcagcctcccaaagtgctgggattacaagcatgagccaccgtgcccggctgaccctgttacttaaaaaaaaaaaagagagagagagagaggtggctgtgtcttttgccccttttcctaccttctctggtgagaataattaggacaagggttaaactttaggagtcacagaatgttaagctgaaaggacttacctcagagctttgtttacataaataagaagtaaacctcaatcttgtataaaccactgggttttctgtcacagctaagcataatcctagctgaatcagatgttatggagcgtttctgacattatttctttgaagcntttctaatttctataccccttaaatagcatacattattacagtatttttaatgatttcttatattatggttagatggctgtgtcatcaattagagtataaactctagaagcactactgggtcttcatttctgcactacccttaggccatagtttttctttgcatatttctgttcccaaattgggaaatggttacagaagaagaaaaaagaatatgggacaaataatctgaagaatctacaaactggcttttacacaatttgggaccctcctcatctctgactctgatggaaatgtaaggagcacgatggttgaacactgacaatgagacg

SEQ ID NO: 37 - DNA, 661 bp, Homo sapiens
  EIF4G3
  misc_feature [331]..[331]: Chromosome 1, SNP identification no. = rs7519685
  misc_feature [331]..[331]: allele = a, in linkage disequilibrium with rs2320590, respectively
  misc_feature [331]..[331]: n is a, t, c or g
ataaatatagtatgtttactgcttattgcttatgtgccatgagaatatactagttctccaaaagtttggaagcaagatccttacaaggtttccatccaaatccaataataattgttttctaatagttgtaatagctcaaggttacttgtaaccaaacacagagacattcttatgaacatatttagaatataaagacagtagactgcagcagggattctactaaaatattctaatttacagatgacatccctctgagcaccattttgaacagctatttcataatatgatacaacagtttttctgggatgacaaagtggctcccaaagttctnaaatgtatgtatggtctttgccctaggtataacagaagatctttgtgaaaactgggtacactgcatccatactcacaaaataattaatgttatcaaccagaatgcacttggtcagctgttgatcaaggctggatggctagagaaacttcctgagaactgacgatgatgatgctagaatatttgtactagaactgatggcacactctccaatgtattccctacgatgtatgaaagatcatttaacagatccagtaataatcaaccatgtgttacactgcatatttcctttcagcaggagacattatcttaggaagaggggaacattttcag

SEQ ID NO: 38 - DNA, 661 bp, Homo sapiens
  EIF4G3
  misc_feature [331]..[331]: Chromosome 1, SNP identification no. = rs2167811
  misc_feature [331]..[331]: allele = a, in linkage disequilibrium with rs2320590, respectively
  misc_feature [331]..[331]: n is a, t, c or g
acgtatattgtaataacatagctatcaaagaaaggataaagcaaagttagctcactaagcaataaagagaaaatcacaaaatgcaagagaaacaaaagtctgctatcccaaaataatggtcaagaggaatttcacatgaattggggcataaagaacatgtaatcatgcataaacttttcagatatattcacatggaagtattaaaactgaataactagcagaatgactacagatttacaaaaatgtatctctgaatgaatgaatacctagctatacagctccttgaagacttgttttggaatatgatcttaataccctctggggatggttnacagggctgtggaaatatggaaaggggccagtgagaacatatcctctgagaatagtgattcatggtgattttcttttttttttttttttgtccttaggggatggtaaatttgacagggctgtaagtgagcacttgttgtctgctggacactgggtggtcaagagacccactgagattggttagttggaacagaacatgaagagtggataccttaatctgcttgggctgctataacaaaataccatagactgggtggcttaaacaatggaagtttatttctcatagtactgaaagctgcgaagtccaaaatcaatgtactggcagattaag

SEQ ID NO: 39 - DNA, 661 bp, Homo sapiens
  EIF4G3
  misc_feature [331]..[331]: Chromosome 1, SNP identification no. = rs3890762
  misc_feature [331]..[331]: allele = g, in linkage disequilibrium with rs2320590, respectively
  misc_feature [331]..[331]: n is a, t, c or g
aaattcgttttctagattttgtttataccgttttaccattctaaactgtgtaaacctgttacctatggactcacacacgatacaataaaacatgacaaccttttctttacttaatcgacccgtaccaccgcgtacggatagtgcggtcgatgaaccctccgactccgtgctcttagtgaacttgggtcctccacctccaacgtcattcggttctaacgtggtgacgtgaggtcagacccactgtctcgctctgggacagagttttttttttctgtctcttttcttttctttacctcagatgggttaacgaaaaagttctactgtacaggtncccggtcacaacgggttttcactttacgggttttaactcgacaatcatacacaaagtcgttacgaccgtattcgtctaaacaaaggaagttcggggacaaatgatacgattacaaaggacacttcagtctgtcctttctagatgacatatgttgtaaaaggtttggagatctggtgtccgtaaattttcttaagggaattccattaataatcgaactttttattatggagggttgtcttagtttctttgacttctgtcacttattttttaacttgatcatagaccctcagactagagttggtccctgtaagggagggtgggggtgaagtc

SEQ ID NO: 40 - DNA, 661 bp, Homo sapiens
  EIF4G3
  misc_feature [331]..[331]: Chromosome 1, SNP identification no. = rs10737452
  misc_feature [331]..[331]: allele = c, in linkage disequilibrium with rs2320590, respectively
  misc_feature [331]..[331]: n is a, t, c or g
tggccaggctggccttgaactcctgacctcaggtaatccgcctgccctggcctcccaaagtgctggaattacagctgtgagccactgcgcccagccttgcttttgtttcacaaagaaaacatgcaacctttaacactatagacaggtatccccaaacaccaaagttagtttttgtttcatttttgaacattaaataacaaatcatgtagtatctttttgggtctgccctcttttactcaaacttactcttgtgagaatccatgcccatgtagttgtacttcagattcactgtccttgtataaacatgctacgatttatccattctactatnaacaggcattttttcatttttctttcctgtataaaaaatgctacaacatttttgtatatatttcctagcatatgagatatgtatgtttattggttgtgtatatacctaagaattgaaatgctagttatggcagaaaaacttcagctttagtatataatgctaaacaatttccaaagtggctgttgcaatcagtatgcgagagttcttgttgtttcacgtttgtaaatatctggtacatttagcaatttgatgttattgcatagtacatgaacatcttcaacattattgcccaattgccctcataaatggttatattcgtctttaaaaaca

SEQ ID NO: 41 - DNA, 661 bp, Homo sapiens
  EIF4G3
  misc_feature [331]..[331]: Chromosome 1, SNP identification no. = rs10916891
  misc_feature [331]..[331]: allele = t, in linkage disequilibrium with rs2320590, respectively
  misc_feature [331]..[331]: n is a, t, c or g
atctttttgggtctgccctcttttactcaaacttactcttgtgagaatccatgcccatgtagttgtacttcagattcactgtccttgtataaacatgctacgatttatccattctactatcaacaggcattttttcatttttctttcctgtataaaaaatgctacaacatttttgtatatatttcctagcatatgagatatgtatgtttattggttgtgtatatacctaagaattgaaatgctagttatggcagaaaaacttcagctttagtatataatgctaaacaatttccaaagtggctgttgcaatcagtatgcgagagttcttgtngtttcacgtttgtaaatatctggtacatttagcaatttgatgttattgcatagtacatgaacatcttcaacattattgcccaattgccctcataaatggttatattcgtctttaaaaacatttaaaatgggatttttttttcaatctagtgggggtgaattttacagaactatggtttatcttttcttagtttatcacttccctaataatgaataacattgaatgtcttttttttttccttaaaaaaaaaaaaaaaccacgagatacaggtgcaggatgtgcaggtttgttacataggtatacatgtgccatggtggtttgctataccta

SEQ ID NO: 42 - DNA, 661 bp, Homo sapiens
  EIF4G3
  misc_feature [331]..[331]: Chromosome 1, SNP identification no. = rs4654725
  misc_feature [331]..[331]: allele = t, in linkage disequilibrium with rs2320590, respectively
  misc_feature [331]..[331]: n is a, t, c or g
cgtctttaaaaacatttaaaatgggatttttttttcaatctagtgggggtgaattttacagaactatggtttatcttttcttagtttatcacttccctaataatgaataacattgaatgtcttttttttttccttaaaaaaaaaaaaaaaccacgagatacaggtgcaggatgtgcaggtttgttacataggtatacatgtgccatggtggtttgctatacctactgacctgtcctttaagttccctcccctcaacccccatcccccaaaaagccctggtgtgtgttgttcccctctctgtgtccatgtgttctcaatgtgaaactaccanttatgagtgagaacatgcagtgcttagttttctgttccagtgttattttgctgaggatgatggcttccagcttcatccacgtccctgaaaaggacatgatctcatttctttttatggctgcatagtattccatggtgtatatgtaccacattttctttatccagtctatcattgatgggcatttgggttggtttcatgtctttgctattgtaaatagtgctgcaataaacacacgtgtgcatgtgtctttatagtagaatgatttatattcttttgattatacacctagtaatgggattgttgggtcaaatggtacttctggttctagat

SEQ ID NO: 43 - DNA, 661 bp, Homo sapiens
  EIF4G3
  misc_feature [331]..[331]: Chromosome 1, SNP identification no. = rs4654726
  misc_feature [331]..[331]: allele = a, in linkage disequilibrium with rs2320590, respectively
  misc_feature [331]..[331]: n is a, t, c or g
ttgtacttattgccagatcatttcaaaggccattttcatcaatatcactcctccattaaactacctaaacaccacttaactgcctatctgataaaattcaaaactgggaaagagcattaaagtgtgatccagaggatctgggatctagtcctaattttaatgagtcatggatgtcatggctaccacaatgaaaatgagagcccagaaatggagaattagtttgcttccatataactatggcacatcaggaggcactatggcaagtgattgagttaaataatccctgatttgaattctagcaatgccacttactagttacatcaccctgagnagttatttttccttttcaagctcagcttttggttcaataaagtggggctagtaacactgaccattcaggattagaataaccattaaaaataatatgtatatataaagcctctatccatattgcaacttagtaggtgctgaatagactatttttattataataatcatcctcattctatagccaacattcaaaaccttcacaaattggacctaaaaggtctaacatagtttcaatttatttagggcttactacaggccaaacactgggctagaaattttgtaatctcatttattttaattaattttatccttataatattacaagtggtat

SEQ ID NO: 44 - DNA, 661 bp, Homo sapiens
  EIF4G3
  misc_feature [331]..[331]: Chromosome 1, SNP identification no. = rs17449966
  misc_feature [331]..[331]: allele = g, in linkage disequilibrium with rs2320590, respectively
  misc_feature [331]..[331]: n is a, t, c or g
caaaactgggaaagagcattaaagtgtgatccagaggatctgggatctagtcctaattttaatgagtcatggatgtcatggctaccacaatgaaaatgagagcccagaaatggagaattagtttgcttccatataactatggcacatcaggaggcactatggcaagtgattgagttaaataatccctgatttgaattctagcaatgccacttactagttacatcaccctgagaagttatttttccttttcaagctcagcttttggttcaataaagtggggctagtaacactgaccattcaggattagaataaccattaaaaataatatgtntatataaagcctctatccatattgcaacttagtaggtgctgaatagactatttttattataataatcatcctcattctatagccaacattcaaaaccttcacaaattggacctaaaaggtctaacatagtttcaatttatttagggcttactacaggccaaacactgggctagaaattttgtaatctcatttattttaattaattttatccttataatattacaagtggtatgaattaatctcattttatggattaaaaacaggggcttaaagagatcagtaactattctaaggtcataaagttaggaagtggcagagtagaaactatct

SEQ ID NO: 45 - DNA, 661 bp, Homo sapiens
  EIF4G3
  misc_feature [331]..[331]: Chromosome 1, SNP identification no. = rs7545133
  misc_feature [331]..[331]: allele = t, in linkage disequilibrium with rs2320590, respectively
  misc_feature [331]..[331]: n is a, t, c or g
taccgttactagacatcgacacatgtttgcgtaagccacagagaaactgggttcatcaatagccttctcaaagaccaggtcaataactcctttcagccgctcctctgtgtcaacagtaagtcctgacacttgcttcatcagttgattgaacatctgtggtgtcaatttatttaagatacttcgaacttttctaaaaagctcctagaagggccacaaaaaagaaaaaagcattagagtaactgtgacaatatggtgctttctgtaatgattaattttaaaaataatatataagttcaacttctcaaattattaacaaggactgtgaactagngacagaaataattaaactaatctattttaacaaatagtcaaaaattaccttcttttcactactgaggagaattctagaaataggtatatacacacttagctggtgggagcattatctgttaacatttctaagggcaatttgacaacgtgtatcaaaagctttaaaactgtgtatgtaacctttgaaccagtaattacacttttagaaatgtatttatatttagagatacgtaaaaatactttagccacataactcattacagaaaataactttgatgtaaaaaaatagaaatttgtctaaattatggtataatataaataatggtatgaa

SEQ ID NO: 46 - DNA, 661 bp, Homo sapiens
  EIF4G3
  misc_feature [331]..[331]: Chromosome 1, SNP identification no. = rs4654881
  misc_feature [331]..[331]: allele = t, in linkage disequilibrium with rs2320590, respectively
  misc_feature [331]..[331]: n is a, t, c or g
gtggcacatgcctgtagtcccagatacttgagatgctgaggagggaggatcgcttgagcccagcaggtcaaggctacagtgagctgtgacagagccactgaactttaaccttggtgacagagtgaaaccctgtctcaaaaaaaaaaaaaacatttcgctataactaaatatctagttgatgtccagtaaattctgtgttaggtacaaatgaagcacgaaacacagttattgccttctacagaatcaaaatctagttgcagggacaatacatttaaaaacgaagtgataaagcaagtactagggttgattagagaccagaaaggggaatagnttaggtacatgaggtcagaggaactggattagtcgaggaatgcctttagaaggaaatgagggccgggggtggtggctcacgcctgtaatccccgcactttgggaggccgaggtgggcagatcacgagttcaggagatagagaccatcctggcttacacggtgaaacctggtctctactaaaaatataaaaagttagccaggcatggtggacacgcctgtaataccaactacttgggaggttgaggcagaagaatcacttgaacctgggaggcggaggctgcagtgagccaagatcgcaccactgcactccaggctgggtgacagagcgag

SEQ ID NO: 47 - DNA, 661 bp, Homo sapiens
  EIF4G3
  misc_feature [331]..[331]: Chromosome 1, SNP identification no. = rs2290381
  misc_feature [331]..[331]: allele = a, in linkage disequilibrium with rs2320590, respectively
  misc_feature [331]..[331]: n is a, t, c or g
tgactacgccaagcaatgctagatgcaaagattgggtactaggtactcaaactggaggtaatcttttttgggggtaaaaaaaataacttcagaataccatcaatgtaatgttctccaccactacaacttttgaacaagaggcctttttgaaccagatgtttgacaaagccgttacttctaatgagaaagactagtcctaatttaagcttatcttttattagttgaataactgtggactggtcacttcaataattacaaaaattcacaggtaggtatcatcatagttacaaatctgctaaaactgggtttctacaatcccagggtaaaatgnaaatttaatatcatcactaagccttactgtagatcataaaagattccactcattatgctgggtcagaaatactaaaataagcccgttatatatcatcaatgagagtcaaactaaattactccctgaaaaaaaaggcttccttttatttgtctgctctgttcctgctggattcccactatacccttatgttaaaaccaatgtatgttgccatgttatactgccagcacactaagtagagataacagagtaagttaaaagttgcattttgtgtatcaaaatattcataattactatcttaaatgcttggaaataatttttcaaggttaaata

SEQ ID NO: 48 - DNA, 661 bp, Homo sapiens
  EIF4G3
  misc_feature [331]..[331]: Chromosome 1, SNP identification no. = rs4654883
  misc_feature [331]..[331]: allele = c, in linkage disequilibrium with rs2320590, respectively
  misc_feature [331]..[331]: n is a, t, c or g
caaactaaattactccctgaaaaaaaaggcttccttttatttgtctgctctgttcctgctggattcccactatacccttatgttaaaaccaatgtatgttgccatgttatactgccagcacactaagtagagataacagagtaagttaaaagttgcattttgtgtatcaaaatattcataattactatcttaaatgcttggaaataatttttcaaggttaaatatttgggttgatactaagctctgctaccttcaagcagacctgctgcatgttgacaacctttactttttctgatatatcattctgttagtgctgggcaaatactgccancagatttttttttttttctttctgagttgcactgaagggctagccattagatttcaagagagaataaaaacttcatacaaagcacacatagatgagaatcatttctcacttaaggccccaatgctgcccttttgaattcatttaacgcttcagagaaaaaagtctagactttaatgtcattcattacataaaaatacagtttctaggcgataacacagtctggggcctaagctgataagctcaaacacctttacacatcaatcattctcagaattattcctttatgcttcaccatctgccccaattagaaatggtagtatcaagaatgca

SEQ ID NO: 49 - DNA, 661 bp, Homo sapiens
  EIF4G3
  misc_feature [331]..[331]: Chromosome 1, SNP identification no. = rs4654727
  misc_feature [331]..[331]: allele = c, in linkage disequilibrium with rs2320590, respectively
  misc_feature [331]..[331]: n is a, t, c or g
attaataacttactaaatggttggctaaacctcaggtaaacaattatatcacaagatatttaatttaatccatgcatttgtacataaacattgtcaagaacaaatgtttctggatgcaatgaaaggaaattatgtcaaaaccaattaagagccatagatgcacattaggagacaaagtcagaaaatgcccattaccaaaacctactgcaaacaccaatgaataaatatgccttgagatttgaatctggaaaatggcaatatgatttattccacacctctttacctgacccaagacaaatatgtgtgagtttcaaatgagcaacagagagangtgagaaagtaacaataatgcttcaaaggaaaaaaaactttgaaaagctaactgataaattgttagtccaggataaaatagttaaaattataacccacgtgaaagcacccaagaaaaaattttaaattataattgtatctctggttataactaagataaagacactgttctcaaatatttatctagctattaatagatctactatacttacaaattcttaatatgttcaattaatcaatctctaatgtgcccatatttacactctgagaatgaattcactgtttggaatagcaatgcctggaaaactgtggtgtagtgaacttaggagac

SEQ ID NO: 50 - DNA, 661 bp, Homo sapiens
  EIF4G3
  misc_feature [331]..[331]: Chromosome 1, SNP identification no. = rs2275468
  misc_feature [331]..[331]: allele = t, in linkage disequilibrium with rs2320590, respectively
  misc_feature [331]..[331]: n is a, t, c or g
aatcagcaaaggctggtgtaaagtctggtcctcgaggcaaaattcgaggatccagagttcgcattggcaatttgggttggttgatctgcatgaaaaagcaaaagaaagcttaatacatgttccagagcattccctgccacaaaagataacaaaaatttttactgaaaagttacatcagctgaaacggtaagcaccagctttggaacccgcagaagtccaatctcatccatggcagcttctcctgggctactcttagagccattaggctaaaacaatggttttctgatacgctgggaatgatttaggccttaaatttccaagtaggggctanacataatcagcagactggctcactagatactgaggaccaactgaatggcacaagacaagatattttgagatcctctatactagggtcaaattttagaattaaaaaaaaatattcatcaggatatagagcacttgcctatacgaatcctgctactgctcattttagttttgatgctgtagacttatggttagtaaagaatgtactatgagtggacaataagtcttagaggagacatgtttcataggtgatgattcatttaaaatttcactgtctgccttgttaatctgagatatctgactttgaataagcatgtaatgtgaccatggacaa

SEQ ID NO: 51 - DNA, 661 bp, Homo sapiens
  EIF4G3
  misc_feature [331]..[331]: Chromosome 1, SNP identification no. = rs6704421
  misc_feature [331]..[331]: allele = t, in linkage disequilibrium with rs2320590, respectively
  misc_feature [331]..[331]: n is a, t, c or g
atttaggccttaaatttccaagtaggggctatacataatcagcagactggctcactagatactgaggaccaactgaatggcacaagacaagatattttgagatcctctatactagggtcaaattttagaattaaaaaaaaatattcatcaggatatagagcacttgcctatacgaatcctgctactgctcattttagttttgatgctgtagacttatggttagtaaagaatgtactatgagtggacaataagtcttagaggagacatgtttcataggtgatgattcatttaaaatttcactgtctgccttgttaatctgagatatctgacnttgaataagcatgtaatgtgaccatggacaacataaagttaagcagatcagtgagaaatcaactaattagtggccaaagtcataaacagataaggcagcaggacaggcaggaatattttctaagaggataattgaatttggtggatataacacttgacttctgaggtactgaagtagcctcaaattagcaccattaatcagtcattcagctgtcctcacataagtatctaggagagaagacttagataccaccaatagaagtaagaagacctgttgctataagaaagtaaaatagtataaatgagttctggataagcagctgctggacat

SEQ ID NO: 52 - DNA, 661 bp, Homo sapiens
  EIF4G3
  misc_feature [331]..[331]: Chromosome 1, SNP identification no. = rs17410008
  misc_feature [331]..[331]: allele = c, in linkage disequilibrium with rs2320590, respectively
  misc_feature [331]..[331]: n is a, t, c or g
gctatacataatcagcagactggctcactagatactgaggaccaactgaatggcacaagacaagatattttgagatcctctatactagggtcaaattttagaattaaaaaaaaatattcatcaggatatagagcacttgcctatacgaatcctgctactgctcattttagttttgatgctgtagacttatggttagtaaagaatgtactatgagtggacaataagtcttagaggagacatgtttcataggtgatgattcatttaaaatttcactgtctgccttgttaatctgagatatctgactttgaataagcatgtaatgtgaccatgnacaacataaagttaagcagatcagtgagaaatcaactaattagtggccaaagtcataaacagataaggcagcaggacaggcaggaatattttctaagaggataattgaatttggtggatataacacttgacttctgaggtactgaagtagcctcaaattagcaccattaatcagtcattcagctgtcctcacataagtatctaggagagaagacttagataccaccaatagaagtaagaagacctgttgctataagaaagtaaaatagtataaatgagttctggataagcagctgctggacatctttactaacccatttatgccggaggc

SEQ ID NO: 53 - DNA, 661 bp, Homo sapiens
  EIF4G3
  misc_feature [331]..[331]: Chromosome 1, SNP identification no. = rs4654729
  misc_feature [331]..[331]: allele = t, in linkage disequilibrium with rs2320590, respectively
  misc_feature [331]..[331]: n is a, t, c or g
aggacacaaaacacagaaacaacttatttaagataatgaactgtctatgcagttagatactaagttttttctcctgcctataatttcatctaaaaaaaaatcacagttttcttattttaattaataaaactcatcaaaatcagactccagattacttcctgatagcagattggatccttcttacattagagattcctaatgtgtaggttatagacccgctgatgggtctttgagaatattccaaatgttttccaccatatctttattaccctattatatttattaaaaagtagacagcttattgggatctaaatttcaaactgtttttttnccaatgactattgtcttttttccaattactgctgttaaatattacaagggcaaaaggtagttggtcaattatagtcagggcctatactgtaaaactgatggatgaaaagaattaaaatataatataaaatataagtaacataaattatgcaatatacaaaatattaaaacataaaataaattaatataaaaatataatttgcatagtctaaaaatagcaatagtgtttccattttcttaagacacattggtgatggctacaagtactctgtgacctggtacaagcctagatctttttctttatttttgaacacagtatacaagcctaagt

SEQ ID NO: 54 - DNA, 661 bp, Homo sapiens
  EIF4G3
  misc_feature [331]..[331]: Chromosome 1, SNP identification no. = rs3767247
  misc_feature [331]..[331]: allele = c, in linkage disequilibrium with rs2320590, respectively
  misc_feature [331]..[331]: n is a, t, c or g
aaaaaaaaaaagagagagagagaaaaaaaaaagagaaatctgggttatggagtatcacacctattttcagaaggcgaaaaagaattgaagttattccctagattatttttgaccatcttagcgtcagatatcaaacacaaatggctctgtaaaggcctcatgaatcttcaaaactccttgaggcaaagttctctgtgaactcttttcacgatgggtatgcactctgaaaacaatcctctgaaacaactactcagaggtgttctaattgataaattcacacgaggagaagagccaaaaactggagctggttcagcagaggatagtgtaaagnagtgtcatatatagcagaaaaaagttcaccccaaataatctatgaaattatgtttaaaacaatttttgagtgacaaatacttctttgttagatagtattaaaacagatataatactagtaaattttcttttaccatataacagatcatggttgaaaagccaataaattgtttaatgttatcaacagaaacagatggtttttagactctgtttctaataatggaaataaaaagttcatgcaaatatgcacaaacaccaccccacacctattcccccgactaattcatggaaaaagatagtatataaaaaccctcaaaagacagacagacat

SEQ ID NO: 55 - DNA, 661 bp, Homo sapiens
  EIF4G3
  misc_feature [331]..[331]: Chromosome 1, SNP identification no. = rs4654887
  misc_feature [331]..[331]: allele = t, in linkage disequilibrium with rs2320590, respectively
  misc_feature [331]..[331]: n is a, t, c or g
atagtatctcattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcagatgagtaggttgatttttgcaaatttttatgctattggaacaaaatgtttttcttcagagctgttttgtaaaacgtctaatggacaaattaacagacatgtttaatcattgggctttagggagattctntgtcttctctctatgtaagttttaaaactgtgctacagtttactgttcctacagttaattggagggaaacaatttttgatgtgttacatcaaaaattctgtaactggaaaggacttcatcttaagatttcaaaaagagcgcaccttacagtaacatttttctggtatctgtaggatgtaatacaagtcatccccataaatggaagagtctcttagtttttcatttactttttatgtgggcttaactggattcaaattgttactcctgcaaattaagacctaacaactatccctatacaacctaagagataaacactggacttggagactg

SEQ ID NO: 56 - DNA, 661 bp, Homo sapiens
  EIF4G3
  misc_feature [331]..[331]: Chromosome 1, SNP identification no. = rs10916900
  misc_feature [331]..[331]: allele = g, in linkage disequilibrium with rs2320590, respectively
  misc_feature [331]..[331]: n is a, t, c or g
cactgcactttagcctgggtgaaagagtgagacttggtctcaagataaaatttttaaaaaattaataaagctgttttattttctacatttgtggagataattttctgggttggcctgaagcgcctgaattgtgcagattagctgaagatcttgtggccacataacggctaagtaagagactctgaattacaaaaaagtctcccttgtagctccacatgcttttggaatacaacataaactccctagttccaaggtttgaaattaatgtgtccagagtctgggtctcttagattgaagtgacacaaaactgagactgcgaagactttccaantatagacacttcactaatgctcagggaacagccccggtgcattgccacagagttgtgcataaacaaagtagaatgttctaataatggaactttcagtgagagttcccatccttatcacctggttttaatcccttctcatccattcttgatatattttgacaatttttacttttttccaagttttgagatctacaagttggcactaaatcattctgattagataatatgcaagaactttgtccctctagagttcctataggctgtgaatcctattctgtcccaaatcaccacctcttttcctttcacagatcttcatgggaatctaggaaa

SEQ ID NO: 57 - DNA, 661 bp, Homo sapiens
  EIF4G3
  misc_feature [331]..[331]: Chromosome 1, SNP identification no. = rs6699704
  misc_feature [331]..[331]: allele = g, in linkage disequilibrium with rs2320590, respectively
  misc_feature [331]..[331]: n is a, t, c or g
tttaagccattatgtttgtggtgattacaacagcaatagaaaatagaaaatgggtgggttttcattttcattcggttcaaaatattttataatttctgatttcttctttgacctctgcgttatttaaaagtgtgttagtttctaaacatatgggggattttccagagatatttttctcactgatttccaacttgaatccttttaaagttattaagcctcgtttctggaaccacaatatggtctatcttggtaaatcttcaatttgtatttgaaaagaatgtgtatctactgtttgaatgtttagtcaattaaatcaagttggctgactatnctattccagctcctaggtccttactagttttctgtttactggttctaccaattctgtgttttccagttatgtcgattccttatctctactttttgaatatgtgaaatacagttatagcaaccgtatctaataaccctctaatgattttgtctgctaattctaagcatgtcagttgtgagtttcaatcgatttgttttctcctcatcatgggtcatattgttttcatggtgtcactgggccaaaaagcaagaagatatcatcaggtctgtgactcctctggaggctctgtggaagaatctatttccttgtcttttttatctgttagagact

SEQ ID NO: 58 - DNA, 661 bp, Homo sapiens
  EIF4G3
  misc_feature [331]..[331]: Chromosome 1, SNP identification no. = rs10916903
  misc_feature [331]..[331]: allele = c, in linkage disequilibrium with rs2320590, respectively
  misc_feature [331]..[331]: n is a, t, c or g
accctaaatataccatatgcataaagaaaaaaaatcttctaatttttccgttgatcaaatacctattttgtgcagagaacaattccatatgttgttatttggaaatgaaaaagcaaaagccaagaaaagccaatacaattttgatgtagaatttaaaggtagtgggcttgtaatattaggatattataaaactaaagtaacgaaggtaattgtgctattgatgcaaggttaggcaaagagaaaagaagtggctcaatagaaaccattaatctgaatgcagtgttgaagcggtgtatcagcttaaccaacagtgtgcctcattatataaacngacctcagtccttgaccattccgaaagaacagctgttggattccaaaccatgattttaaggtcatggattatgtcacaggattgcaatgtgagacatctgtaccagggactagataccagaccctcaaattataccaagatctgagctggtgattccacagccatatatgctaaactggaagaatactgttgaattcaattttttgtcattatactccagcttctgatattgccaggtgaggagataatgcttacttaagtatgcagcctaaaagcccccgcttagctaaatgtttggactcttttccaaagtggcatggaaagtagaag

SEQ ID NO: 59 - DNA, 661 bp, Homo sapiens
  EIF4G3
  misc_feature [331]..[331]: Chromosome 1, SNP identification no. = rs11805006
  misc_feature [331]..[331]: allele = t, in linkage disequilibrium with rs2320590, respectively
  misc_feature [331]..[331]: n is a, t, c or g
gctaagaataattattagggtttgagttctttgaggataaggattgtattttgttggtctcttcaatctacccagcaaccaatacagtgcctggcaaatctgttaatgaataaatgacctgcaatcaaaattaaacccaaggttaatgtctctctagaacaacaatactggttaaatctctttgtgtaggtagtattacagtattcccatttcagagatgaggaaactgaagaacagagagattataagtttcccctttacagagagtaaaggttggggctagaactgaaacacagatctaacttcaaaacgcttccccactcaatacccnacctctcaagtctgccttatccttcactttcttgcctgaattccagcttcatttttatcttggttaaagttgtcttttgcttttgtagcatgacaggatgtgcagtttgttgccccaacagcacagtatgtcattaaaaaaataaaatggcaaagtgacactaagtaggtttgctccaaaaagttcagtggaggacagtccattaagcaattgtcgacactgagaacaaagatgactccaatgagaccactggcatatcttctaggcctctgtttttactgctctgtgttttaggcacttttgcattttaataagacacttttgaaccac

SEQ ID NO: 60 - DNA, 661 bp, Homo sapiens
  EIF4G3
  misc_feature [331]..[331]: Chromosome 1, SNP identification no. = rs6692677
  misc_feature [331]..[331]: allele = t, in linkage disequilibrium with rs2320590, respectively
  misc_feature [331]..[331]: n is a, t, c or g
atattactgcaaaatttataattaaacttgcttctggctttaattatgacaaaagtaattcatatgaacaaaaagatttcacaacaaacgaggaaaaactgaaaaagtcttgtcttccccatcttgctcttaggtctctctccccagagaaaatcattattaagtatttcctacttatcctcagaaaatactggtgtatatgcaagcacatatatgtgtgcattatacatgtgaatgtgcatacaggtttctcctttatttatactatacgtactgttttacaccttggtatggctttaaaattagagtaaaactcatttgtaagatatanagaaaagccatgttttaggggttattcatgatttatacaatttatggaacatcagtgtataatatcatgtcaaagggaggttttccctacatgatcaggtatactgatttaaatatttcaaatatcactcaaatcttatttgaattctgttaaaaactaatataaattatgacagtctgggactcaataaatacctgttgaatgaatgacaactattaataacggtattatgttacaaaagccctaatagtttttggatgctattaatcatctcattgaatgctatcacataaataatgacttctatttttatttctatacgttttagca

SEQ ID NO: 61 - DNA, 661 bp, Homo sapiens
  EIF4G3
  misc_feature [331]..[331]: Chromosome 1, SNP identification no. = rs17450586
  misc_feature [331]..[331]: allele = t, in linkage disequilibrium with rs2320590, respectively
  misc_feature [331]..[331]: n is a, t, c or g
tcatgaagaaccactctgctttgccggcccaactggatatttcatatctgtgacatcgagcaatgcctctagaatgattgctacaggtgttttttgttttgtttttttgacagggtcttactctgtcacccaggctggagagcagtggtgtgaacatggctcagtgcggcctcaatctcaaaggctcaagcaatcctcccatctcagtctccagagtagctgggactacaagcacacaccaccatgcttggctaattttttatttttttgtagggacgaaaggtctccatatgttgcccaggctggtcttgaactctacaggtggtacatncaataccaagctgagaacaccctctcaaactgaggtaaaatttaactagtagtaaagtaataagacagaataaaaacaatacagtttttatgtatacactatataagtaattgttgtataaatttatttatacaacaatagcatgtgtcaaaagatgatataatttttggctgtacacaaatactcctgtatctccgatactgtcaattgtggtgttcttgttgaaatttacttcctcaatttctaagctataacttccctaagcaaatccttatatagatgctggtggcaccaccatatcatactcatttttcttttatttgagacagt

SEQ ID NO: 62 - DNA, 661 bp, Homo sapiens
  EIF4G3
  misc_feature [331]..[331]: Chromosome 1, SNP identification no. = rs12407731
  misc_feature [331]..[331]: allele = t, in linkage disequilibrium with rs2320590, respectively
  misc_feature [331]..[331]: n is a, t, c or g
tcccatctcagtctccagagtagctgggactacaagcacacaccaccatgcttggctaattttttatttttttgtagggacgaaaggtctccatatgttgcccaggctggtcttgaactctacaggtggtacattcaataccaagctgagaacaccctctcaaactgaggtaaaatttaactagtagtaaagtaataagacagaataaaaacaatacagtttttatgtatacactatataagtaattgttgtataaatttatttatacaacaatagcatgtgtcaaaagatgatataatttttggctgtacacaaatactcctgtatctcngatactgtcaattgtggtgttcttgttgaaatttacttcctcaatttctaagctataacttccctaagcaaatccttatatagatgctggtggcaccaccatatcatactcatttttcttttatttgagacagtctcactctgttgtccaagctggagtgcagtggtgtgatctcggctcactgcaacctccgccttccgagttcaagagattctcctgtctcagcctcctgagtagctgggactataggcgtgcaccaccatgcctggctatttttttctatttttagtagagacaggtttcaccatgttggccaggatggtcttgatc

SEQ ID NO: 63 - DNA, 661 bp, Homo sapiens
  EIF4G3
  misc_feature [331]..[331]: Chromosome 1, SNP identification no. = rs10916906
  misc_feature [331]..[331]: allele = a, in linkage disequilibrium with rs2320590, respectively
  misc_feature [331]..[331]: n is a, t, c or g
agaaagaagctcggtatgtattagcaccgtctccccactctcttctctccccaacccctggtgagcactaatttattttctgcttctatggatttgcctattcctgacatttcatacaaatggaatcatataaaatgtggtcttttgtgacttttttcacttagcgtaatgtttttaaggttcatccattgtacaccatgtgaatttcattccttatcatggtccgatatttcatggtatgtatatatcacattttgtttattcatgcatcagttgataaactgatttgggttgttaccactttatggctgccctattcattttccccccnattcttctgagctttctttgcctttcttcctaattttccactcctgccaaagcaggaagttaatgatggtattaccatcctcaactcaactacagattttccttcactgttctaaggaggccttctcctttaccaatcacagcagaggtcaccttgagatgtgtctactgtgaagataaatgacataatgggtacaaaaacttttaatcaacattatacatgcaaacggcctatcctaagggattttccaccatctcatgtcccagattttattaaaaacatttcagaaggtatcaactccttgagcttcctttctttggaagataaatt

SEQ ID NO: 64 - DNA, 661 bp, Homo sapiens
  EIF4G3
  misc_feature [331]..[331]: Chromosome 1, SNP identification no. = rs6698440
  misc_feature [331]..[331]: allele = t, in linkage disequilibrium with rs2320590, respectively
  misc_feature [331]..[331]: n is a, t, c or g
cactccaggctggagacagagcaagactctgtcttaaaaaaaaaaaaagaaagtaggtagatggtttcttctaacataaggcggtttcatctacaatatcagtatctgttggttttcaacaaatattgaaaatgtgtaatttagggtagccactatcatcaattatcttagctagatcatctggataacttcctgtggcttctctatcaccacttgctgcttctaccttgcacttttacgttatgatgacatctttcctcaatctcatgagccaagctctgctagcttcaaacttttcttctgcagcttcctcacctcactcagtcttcanagaactgaagagacttagggcactgttttggatgaggctttgacttaagggaatgttgtggctggtttgatctatccagaccactgaaactttctccatgtcagcaaaaaggctgttttgcttttgtatcatttgtgtgatcactggagtagcactttaaacttccttcaagaacttttcctttgcattcacaactttactgtctcaaggggcctagctttcactctgtctcagctttcgatacatattcctcactaagcttaatcatttctagcttttaatttcaagcgggagacgtatgactcttcctttcacttgaacacttagaag

SEQ ID NO: 65 - DNA, 661 bp, Homo sapiens
  EIF4G3
  misc_feature [331]..[331]: Chromosome 1, SNP identification no. = rs10916907
  misc_feature [331]..[331]: allele = c, in linkage disequilibrium with rs2320590, respectively
  misc_feature [331]..[331]: n is a, t, c or g
aatagtgaaaagaatagtagaagacatggtagactattcttaaacagtttgggtcagaagaaaaagataccatttaagtggcagctaaatggttatatgggactcagagagcgtctctggcatgagacagacaataagaaggtggtagagaggcagtgaatacatacgagactgtaagagacaactaagagagtctgatgaaggtttcaatatagccaggtttgtaagggggcagaaagttaaaaaaaaggcgtacccagtgtcctcaatgttctcaataaagaaggagacgaggtcatgtgctgcaggtgagtagcactgggcagagtanaggattttcaacagaaaaaccataaaaataatggttgggatggacagtgtgaatttgtagttgcattcacaccactgtaagtggtgtgatcttctccagtagtgctctgcctactggagtttaatagacaaagtaggagttatagtactgattcaagggttttgataggtatgtttttcaaaaggaaaaagaggaaaatcacagattttgtacagggtagctcaaataatccccctcgtctttgctcaaatcttacctcctactgaggcctatgactctgatcatattatttaaatactacaacctgctgcccctttgcattcctcaccc

SEQ ID NO: 66 - DNA, 661 bp, Homo sapiens
  EIF4G3
  misc_feature [331]..[331]: Chromosome 1, SNP identification no. = rs10442633
  misc_feature [331]..[331]: allele = t, in linkage disequilibrium with rs2320590, respectively
  misc_feature [331]..[331]: n is a, t, c or g
catgagccaccgcgcccggcctcaactgatgcatttttattcactcagaaatatgatctagaatagttacaagaaaatgttttgcagcagaactaaaagataccatatcccttatgttataactttactgctttaaccaactatctctataccaactgatatgttatttatgtatcaggtttctgaagccagctttgaggtgtttcatcctcaggcagagacaagtaaaaactattctcaaaagtcaccaccaaaagactcataggcaaaccagactgttttggtgttacaatttattaacttctcaaagtaaacggctgttatgatttantaacttctcaaagtaaacaaggtataataagtgaatattatgtgaataagtgcaaataaattatagtcattaagcatatgaccacgtcaggtggatatacttaaagactggaggtaattttaattttcattgttaacttttgtgacaaaaccattaaaaaatattcggacagaaatgaatgggtcagaaatgcttctgaggctttataatttacaaactgctggccaggtgtggtggctcatgcctgtaatcccagcactttgggaggctgaggcgggcggatcacaaggtcagtagttcgagaccagcctgaccaacaaggtgaaaccc

SEQ ID NO: 67 - DNA, 661 bp, Homo sapiens
  EIF4G3
  misc_feature [331]..[331]: Chromosome 1, SNP identification no. = rs12133780
  misc_feature [331]..[331]: allele = a, in linkage disequilibrium with rs2320590, respectively
  misc_feature [331]..[331]: n is a, t, c or g
tgtgtgtgtgtgtgtgtgtgtgtgtgtgtgtgtgtgtgtgtgtgtgtgtgtgtgtgtatgttcgttctagatggaacacaccatatataacaaatatgtatttatcaaaatatctttgatgaaaataatttccagctcactggagtaaataagtcacccagattacataataccactgtgaaagcttatcagactaacaccctttatgaccactgactgaaacctagatgcagtaaatttaaaaatagggcagggtgtgatggctcgcatctgtaatcctagcactttaggaggctgagacgggaggatctcttgagcctaggaatttgcnataagcctcggcaacatagtgagaccttttgtctacaaaaaattaaaagattagccaggtgaggtggcgcagacctgtagacccagctactcgggaggccaagatggaaggatcgtttgagcccaggaggtcgaggctgcagcaagctgtgatcatgccactgcactccaacctgggcaatagagcaagacgctgtctcaaaatgaaaaagggaaaagaaaagtggggagaaggagagagggggagcggggtggggggacagagagagagagaaaaagagaaattgattctcacattaaatatctaataagagtatgtcaattcaattat

SEQ ID NO: 68 - DNA, 661 bp, Homo sapiens
  EIF4G3
  misc_feature [331]..[331]: Chromosome 1, SNP identification no. = rs3767248
  misc_feature [331]..[331]: allele = g, in linkage disequilibrium with rs2320590, respectively
  misc_feature [331]..[331]: n is a, t, c or g
aggggtgctggcagcaagatgagcgctctccacagtcccataaaccacagggctgtgctcggggacctggctgggcagctgctgggatttgaagtacaaaaaagggtgataatgagcgtgcgaacataaaaactagcaacatggaacccaagcaagtagggaagacagtagagcacaggagatcacaaaattaaaaaaggaaagcaaggaaaaaatatatagtccaatttaataaattcaaaagtacatgggaagtcagggaagataaagaaagaggcagcagaaaaagaggaaggaaaagaaatgattactattaaccacagcaagagangacagcacaacaatcattagcacaatttattccccagtgttccttctaaggacaagccgacttgtcaacctaacaatagacgacacatctgagaaggaatttaacaccctcccaaagaccaagaaggatttggtcaacttcatgtataaattacctagcaaagcaggacaaacagaaaatgtaatgaggctgaaaagcggttacagattcaagaaaacaatattgaaaaatgattcctgctacttatccatgtaatcatacaggtgaaatgcaactttgaaagtatgtaataaagcaattttaccataaaatgtctacaggttctgggtc

SEQ ID NO: 69 - DNA, 661 bp, Homo sapiens
  EIF4G3
  misc_feature [331]..[331]: Chromosome 1, SNP identification no. = rs6700459
  misc_feature [331]..[331]: allele = c, in linkage disequilibrium with rs2320590, respectively
  misc_feature [331]..[331]: n is a, t, c or g
gtgttgtggctcatgcctgtaatcccagcactctgggaggccaaggcagacagatcaccagaggtcaagagttcgagatcagcctggccaacatgatgaaaccccgtctctaccaaaaatacaaaaattagccaggagtggtggcaggtgcctgttaattccagctattcgggaggctgaggcaggagaattgcttgaacccaggaggtggaggttgcagtgagccgaggtcgcgccactgcactccagcctaggcaacaagagcaaggctccgtctcgaaaacaagcaaacaaacaaacaaacaaacaaacagtctataacaaaggagtnccttatcttcccaaagaaaaaataatgatgaactattttactaatcaataagtcagaaaaatcaggaaacataccaagtactgtgacacaaaacatcacatccaatgctgtatgcattttgatacatatgaagaaattaagctagacagttaagaatatatttaaggaatttcaaagccactgcattttagtcactttcactattggtgggaatgaaaacttataaaatcattctggaaaggcaatcactaccaaaatataaaataactcaataaagatgctaaggaagtcagagttaaaaggtcagggtcatttagcaagtcttcgcac

SEQ ID NO: 70 - DNA, 661 bp, Homo sapiens
  EIF4G3
  misc_feature [331]..[331]: Chromosome 1, SNP identification no. = rs12137408
  misc_feature [331]..[331]: allele = g, in linkage disequilibrium with rs2320590, respectively
  misc_feature [331]..[331]: n is a, t, c or g
actacaataggcatcaaccacatagatcagttctttctatactaattctttctatactaatatggtttgactgtccccacccaaatctcatcttgtagttcccataatccccattacacacctcaaaaattctatgaatatggacttttgtatgtttttgtatggacagttagtcaatagtgaagagacactggatagtattttgtggggaaacggtgtgatatgatttatgttttaaaaagatcactcacttgggctgttgtgtacagaatcaacagaggagaggcaagacagaagcagagagatgagtgagaaagttcctgttgtctanggagagcaaagtggcttaggctacaataacagcagtgaaggtggtgggaatgagtcaaatgggacttgctgatgtaatgactgtggagagtgaaattaagaggatttaaaggtgagtcctaggcttagaacctcagcaacttaggtagactacagtataatttacaaaaaaaaaaaaaaaaaaaacaaggagagcacatcaaacacctgttgaaatattttattttattcaattttttgagacagggtctcgctctgccactcaggctgaagtgcagtagcatgaccacagctcactgtagcctcaaactcccaggctcaagcaatcctc

SEQ ID NO: 71 - DNA, 661 bp, Homo sapiens
  EIF4G3
  misc_feature [331]..[331]: Chromosome 1, SNP identification no. = rs6697555
  misc_feature [331]..[331]: allele = t, in linkage disequilibrium with rs2320590, respectively
  misc_feature [331]..[331]: n is a, t, c or g
tggctcacgcctgtaatcccagcactttgggaggccgaggtgggcggatcatgaggtcaggagatcaagaccatcctggccaatgtggtgaaaccccgtctctactaaaaacacaaaaattagctgggcatggtggtgcatgcctgtaatcccagctactcgggaggctgaggcaggagaatcgcttgaaccagggaggcagaggttgcagagagccaagattgcacaactgcactccagcctggtgacagagcaagactccgtctcaaaaaaataataataataatttttattactgcgtaacagatgtacacagtttcagtgtacccanaaaaatttaacacattcacataattcaaagataaatatttgtcttttctttatgctaggagcatttgaattcttctctgctagctatttcaaaatgtacaatggattatcgtaaactatagtcaccttactgatctaccaaacactagatcttatttcctctatcaaaccatatagtgtatacaaattcattttaatctatgaaacagcataacaaagcaaggatctctgctcatcatgacgaacagagaataggacacttttcaaatgtcccatttaaaaacttttgagagaatccaccccagtttagatacctatttaaagtctacaa

SEQ ID NO: 72 - DNA, 661 bp, Homo sapiens
  EIF4G3
  misc_feature [331]..[331]: Chromosome 1, SNP identification no. = rs10916911
  misc_feature [331]..[331]: allele = t, in linkage disequilibrium with rs2320590, respectively
  misc_feature [331]..[331]: n is a, t, c or g
atttttctttttttgataattttaggcaatatgtcatctggaagttttcaaattatcacaatgtccaaaaaatttcccaatgtatttactgaaaaaaattatcatataaacgaacccattttgttcaagggtcaactgtaattaataaatggtcatggaatttaaggtttgcaggtatcaacttcataagcagctcaacaaaagactgaataacctgctgactttagtaattttcccaaatggtaggagagattgtatctttcctaagatacgctatcaatccataatttcctaccccaaagccccatagcataggactctctcccatgtnataactgtgtttcattacaataataattctagaagcaggggggaaaaagagtatatcaaggaagaaaggtacataattcatttttaaaaattaagtgatctttggccgggcatggtggctcatgcctgtaatcctagagctttgggaggctgaggcgagcagatcacttgaggtcaggtgttcgagaccagcctgggtcaacacgatgaaaccctgtctctactaaaaatacaaaaattagctggcgtggtggcacatgcctgtaattccagctactcaggaggcaaaggctgcagtgagccgagattgtgccaccgcacttgcactcta

SEQ ID NO: 73 - DNA, 661 bp, Homo sapiens
  EIF4G3
  misc_feature [331]..[331]: Chromosome 1, SNP identification no. = rs6669077
  misc_feature [331]..[331]: allele = c, in linkage disequilibrium with rs2320590, respectively
  misc_feature [331]..[331]: n is a, t, c or g
taatcctagagctttgggaggctgaggcgagcagatcacttgaggtcaggtgttcgagaccagcctgggtcaacacgatgaaaccctgtctctactaaaaatacaaaaattagctggcgtggtggcacatgcctgtaattccagctactcaggaggcaaaggctgcagtgagccgagattgtgccaccgcacttgcactctagcctgggtgacagagtgagtgagactccatctcaaaaaaaaaaaaaaaaaattaagtgatttttgatccaccattcatcctatttggaagtagacaatcttgacatggcatcatgtatttatttttacnctaccgggtttcaatgaagactattaggcataatagctagcatatttctaaatacagggatattccttatgccttactgtcatcatcaggagttgagagatttgatactgagcgagtaacaaaattcttccttctttcccactttaataggtaagaactaaaagggaactctcagattatttcgtacaattcctcattttacagatgaaaaaataggggttttaagaacttaatgttctgacccaaggtcataaatctaagtaacacagtgaaaaccagcagcaagtgttctcgtgagccatgatatccagccatgcacctccatctacg

SEQ ID NO: 74 - DNA, 661 bp, Homo sapiens
  EIF4G3
  misc_feature [331]..[331]: Chromosome 1, SNP identification no. = rs6697284
  misc_feature [331]..[331]: allele = a, in linkage disequilibrium with rs2320590, respectively
  misc_feature [331]..[331]: n is a, t, c or g
ttagatattataagtaatttagagattatttaaagtatatgggaggatgtgcactgtttatatgcaaatactacgccattttacataatgaacttgaacaaccacgaattttggtactgtggagggggcatctttgaacaaatcccctgtagataccaagggatgactgtaattaaagaagacactctgcactcaagaagctcatttatgtagttctaaaaggtaagaagtatacctgttatacatcctaatatgctctcaataacacaggaaatcatctcaagcaacactgtttggtaaaaatgttaaattctcaaccttaatgtttgcnttaacaaaaggtgcagcacttaaatcctaaggttccatgtgaaatgtgaaatactcatttaatgatgaggtttctacaagaatgcagctccttttggcatcatgcgatagttcattaagaagagtggcagcacctcacctgtgctctgattgtgaaaacaatacataaatatattaccaataaaaatttaaaaatattataatttgcaaagagaaaaaacatgtctgtttaaataccatttagatattcgaggctgcgagacaactgatggaaatgaaaagtacagaaagtggctatagaagaaagaagagttcagtagaggttagtgaa

SEQ ID NO: 75 - DNA, 661 bp, Homo sapiens
  EIF4G3
  misc_feature [331]..[331]: Chromosome 1, SNP identification no. = rs2271115
  misc_feature [331]..[331]: allele = t, in linkage disequilibrium with rs2320590, respectively
  misc_feature [331]..[331]: n is a, t, c or g
tataaactgtccaaagggtcaaacgtggaaattgagtgaatatacggatatttaaacgatgtgtctgtgagtagacatgtatacagtaaaataaattggaatatctattcttaagccctaggtttggtccctccatttctgtattgtctcctctaatacagacctccaccgtcgtctttaggatgaggtgggtatccttctgggtgcaggtgtggatgaggaggagtccattctgtctcactcgacattacctaccgtgataaacaagtgattggagatgacttgagaagaaagaagatatcggtgaaagacatgaaaagtaaaggtagtnaacagagcgtcggagcttatagatttaccataaatttgtctgtacaaaaaagagaaacgtttaatattataaaaatttaaaaataaccattatataaatacataacaaaagtgttagtctcgtgtccactccacgacggtgagaagaattacttgatagcgtactacggttttcctcgacgtaagaacatctttggagtagtaatttactcataaagtgtaaagtgtaccttggaatcctaaattcacgacgtggaaaacaattgcgtttgtaattccaactcttaaattgtaaaaatggtttgtcacaacgaactctactaaaggacac

SEQ ID NO: 76 - DNA, 661 bp, Homo sapiens
  EIF4G3
  misc_feature [331]..[331]: Chromosome 1, SNP identification no. = rs6700718
  misc_feature [331]..[331]: allele = a, in linkage disequilibrium with rs2320590, respectively
  misc_feature [331]..[331]: n is a, t, c or g
atgagaatcgcttgagccccagaagcagagggtgcagttcagctgagatcgcgccactgcactccagcttgggctacagagtgagactccatctcaaaaaaaaaaagaaaaagactggtgttaaaggagagtctagatgtgagaactgagcttaaattcctcacactgagtaaaaccttagcccactaaaccctcccagttctaaaggtggagtacatgttgtcatgtagcaaacctagctcagtgaataattaaagatgatattatgcaaatggtatgaacaacttctaattacatgcccatacaaatcctccaggtgaagtggtgtgantataagggaagaataaaaaaaaaaaaggcacagtaatttgtgaattgagatgaataatgactacgtaaacttatctgataagtgaatagattttagatttaaaataagaaaaagtaataaaaatctcttacagtttttttctctctcttggctggaggcggctgttgctgcgtaggcactatgataggtgctgactgatacaccggctgacttgggtaaaaaggcgttcctaaaaagttggaaaaaattaaataggcattcagttattttgtcaaacactacagaactagcaatgacactgtgtctctgcacaatccccttaaaagggta

SEQ ID NO: 77 - DNA, 661 bp, Homo sapiens
  EIF4G3
  misc_feature [331]..[331]: Chromosome 1, SNP identification no. = rs4654893
  misc_feature [331]..[331]: allele = g, in linkage disequilibrium with rs2320590, respectively
  misc_feature [331]..[331]: n is a, t, c or g
gtgaagggtattgcgtatcactttgaaatagcagtttcccaagacaatatcaaccaaggtaacagaaaacttttcccttctctaaaagaagtaaagccacgtaacatttggttgctttgcctacttcacctcaaaactgaaaaaaaaaaaccttcttgggctacttgaatcaaatcaattctgctgtaatcttaactgagacaatcccaattttaggaaactggttaatggataagttatcctgttatattaagattatttaataagtttttgctttgttggttatataacagatcaatgcttactgaatctcaaaacttaatttttctantatctactaattttatcccttattattcaccttccatggaataagagaaatgtaatatgaagtaaaaatttgttgaatgaagtaagtaatttttatcatttttagttcagcattggcgcatatgccaataatcttggcaacccagctctctctaaattaaaaacacttttaatttttcaaggcattttcattggaactaatacccaaaacctcccccatgccatagatcttatcacaattttgcggagaatcacaggttcactgagttatatttagttatggcatgtatattctccaagtgcctgccagtcactgttctaggggctgggg

SEQ ID NO: 78 - DNA, 661 bp, Homo sapiens
  EIF4G3
  misc_feature [331]..[331]: Chromosome 1, SNP identification no. = rs12021529
  misc_feature [331]..[331]: allele = t, in linkage disequilibrium with rs2320590, respectively
  misc_feature [331]..[331]: n is a, t, c or g
acaattttgcggagaatcacaggttcactgagttatatttagttatggcatgtatattctccaagtgcctgccagtcactgttctaggggctggggatatagcagtgaacaaaacaaaaatctctactttcatggaaattgcattctactaagaaagacattaacaaaatctttaaggtgtaaggtggtaggaaatgtttggagaaaaagagattgtgaaaggaggataaggtatattcatgccactggcaaaaatccagtaaaaatctaggtaacagtgaactggtggaagatgtcagaactctgaaacatgattctttccagtagaatnatcagcttgtaaagaagatgtcattaactaaatatatttctataatactcctcttgtaagccactctctaaaaagtaacttttctgtctttttttttttttgagatggagtctcgctctgtcacccaggctgagtgcagtggcgtgatctcggctcactgcaagctctgcctcccgggttcaagccattctcctgcctcagcctcccgaatatctgggactacaggcacccgccaccatgcccggctaattttttgtatttttagtagagacggggtttcaccatgttagcctggatggtctcaatctcctcgcccgcctcggcctccta

SEQ ID NO: 79 - DNA, 661 bp, Homo sapiens
  EIF4G3
  misc_feature [331]..[331]: Chromosome 1, SNP identification no. = rs7540023
  misc_feature [331]..[331]: allele = t, in linkage disequilibrium with rs2320590, respectively
  misc_feature [331]..[331]: n is a, t, c or g
accaaaggggcaggccacagagagtaggtgatggagatgaaaagaaagcacaggaggcaaagttggtaacataggaacctgggatgcaatacaactacaggaaccatcttctagttatctccactgacacagttttggtgacaacatttttttgttggctgctaaaaggaacaataaagcagtaaacctcccattactggactgcatttctcgtaattacaaagcaaacagaatctatcatgcatcaatgcatgtgatctgtaaacaacacttcaggaacaaacttaagtatttttataatgtagttaatatcaggagccacaagaatganacaagcctcaagtagagaagagtcattatctgttcaacttactgggcattgctaaataacacaggcagaggataaaaatcttaatactgaaagatcctttgaaatcaactgtagagggcagcccagccaagataaagggcgtatcaaatgaacacaggtgatcatctattatggtaacactatcatcaaataatgtcaaaatactcctatgttgcctgaagaaatagggtgttacggggtggtaaggagaggagaaagaaaatgaatccattaacttatgcagagtaagaaaaatagatacgggcaatgttttccaaaaattttaacagt

SEQ ID NO: 80 - DNA, 661 bp, Homo sapiens
  EIF4G3
  misc_feature [331]..[331]: Chromosome 1, SNP identification no. = rs10916919
  misc_feature [331]..[331]: allele = a, in linkage disequilibrium with rs2320590, respectively
  misc_feature [331]..[331]: n is a, t, c or g
tacatcattttcttacacataattctactgttcagttagtagactacagcacagtggaaacataacatatatacactgggaaaccaaaaaattcacgacttgctttattgcagttatttgcttgattgtcgtggtctgaaaccaagtctgcaatatctccgaggcatgcctatatttattaacttgcaaagcaatacaaaatatgcttcagtatataggtcagcctactagaagatgaaaaactaacatctgcaattagaaatttccttggtgaatatcttttaaaagtctgaagtactcttgaagaacagtgctatgatttgctggcaanttagaaagggacaagctttaaagagtccacataatgggacatcactcaggtgtcaatttgataatctgttaatccatggtaatttataatggagattattccattctaaattttttctatatttcccggcatgtggtcaatattatataatttaggtttcactaagaatcgggatatggaagccctagagctgagttgttcaatacaggagccacaagccatacttaactacttgtactaaaaattcagttccgggtcaagcacagtggctcacgcctttaaacccagcactttgggaggctaagatgggcggatcgcttaagctcagga

SEQ ID NO: 81 - DNA, 661 bp, Homo sapiens
  EIF4G3
  misc_feature [331]..[331]: Chromosome 1, SNP identification no. = rs10799677
  misc_feature [331]..[331]: allele = c, in linkage disequilibrium with rs2320590, respectively
  misc_feature [331]..[331]: n is a, t, c or g
gccatgtatatagctagtagagctacagcagtgaaaagcacaagtacagaacattttcatcatcacagaaattctattacacagtgctaccctagaggtttatgtcaggaacaggaggtgttctgtcagatcataagggagagtcttggaaatgagcatccttataaaatacttcactcatgctaaaaaatagcttgggaaaaggggaaaggcaggtagtctcactgctaaaggaaactgacacctaccaaggacttatttcatttcagacactgtgataggcaggtactttatcctcaccacacccataggaaatatatgcagttattanaacatctcagtattatatcatttattagcatattttacccattttgaagatcagaaacttgaggcccaaagataatttgtagtgaagctgaaattgaatcccagttttactgactcccaacatatattttcttcattatttatgctgctactatacaactccttgtgaatgagataccagataaaaccacccatcactcacttgtaccaagctccaaaaaacaaaaagttcataagatcataatttaagatgtcataaggtcgtatagatgcttgagatggcttgctattcatatccatttaactctgttgtgccaggtctggcccattt

SEQ ID NO: 82 - DNA, 661 bp, Homo sapiens
  EIF4G3
  misc_feature [331]..[331]: Chromosome 1, SNP identification no. = rs10799678
  misc_feature [331]..[331]: allele = t, in linkage disequilibrium with rs2320590, respectively
  misc_feature [331]..[331]: n is a, t, c or g
ttcttgagtaaagatccccaacgtctctctcttttaggagtatttgccttgtccctggattaaaatttaagccatgcttctatggcactggactaaattttcaattataaacactcttttacataagaaactaatatttttattattagtagtagtaatactaattctatgtcctagttactatgtgccaaacaccccgctaatcattttattttcattatctaatttacttttcataatagtttcaacatggtattactgtctccgttttacaggtgagaaaactaaggtggagagcagtaaatgatttatccaagaacacttggttaanatggaagaatcaaacctagatctagctgatggcgaagtccaagctcttaaagtattaatactttacaatattatctctgaattaaaaaaaataccctgaggttttatttcactatgaaacccaaacaatagccatccaccccatatagccatcctcctgcaaagtacctttaataactcagatttgctttgcctttacatcctccagattggaaggaatacattttgaaaaacagagtcaggtattaaatcactggaagccttcaactaaacaatatccatttactcagtaataagaattgtaaatatgataacacaggcaaatactggt

SEQ ID NO: 83 - DNA, 661 bp, Homo sapiens
  EIF4G3
  misc_feature [331]..[331]: Chromosome 1, SNP identification no. = rs12123300
  misc_feature [331]..[331]: allele = c, in linkage disequilibrium with rs2320590, respectively
  misc_feature [331]..[331]: n is a, t, c or g
tccattttacatatgaggaaacaaagatgcagaaaaagacttgcctaaccagctggttacatagtaaagcttgtaatatgaacagactaaaccaaagctctttcagcagaagaaaatgtttcagaataccccataaaaagctactggggggttggagggagaaccctgcaagtccttctgtcttgccacctctaaatagattccaataggatagaagtatgaaaccaataggatagaattaatattatttcatttaaaaaattaaaattatttcatttaaaaaaccaataggataaagttatttaaattaattaagatatctattttctangtgttctaataataaaaataattctatccagcaaatggatgtacatgatttttaatcaatttattactagatctaagttagtaactgagtttaagtggttttagaaatactaatgctattttatacacatcaatacaggttatatcggaatgttaacagaaaacccatagaatgctgcctgcttcattcagttaaatttaacttactacaaatatccacaaaatctataaacacttagtatctaaatttttcaaaattgtaaaatttaaaaacaatgcttggcaagaaaaaaaaaactgtagcattttttaaatgtgccataaacagagg

SEQ ID NO: 84 - DNA, 661 bp, Homo sapiens
  EIF4G3
  misc_feature [331]..[331]: Chromosome 1, SNP identification no. = rs2874367
  misc_feature [331]..[331]: allele = a, in linkage disequilibrium with rs2320590, respectively
  misc_feature [331]..[331]: n is a, t, c or g
aggcacaaagagtcagaaacaccacaacaaaaaccaaaatttcacacaatatgccaaaagaaaaaaaacccacagtggggaaataaaaaacaacacacaaaacagtcaaagctttgctgcaggacagtgacagacaggtactaagattcaacaggttaacagcactatcagaatagtttgtcatttatcaactgggagagaaacaggctatgctgttaggcatgtaaggtactctctgataggattatttaaaaaaaaaaaaaaaccctaaaataaggcaaaagcaagtttgaaaaattaagtggttatattaagacaaacatgaaaatcnagtatgctgtatgtaactgatacagctggaggaaatgagaaagcttttacattacaagacctagccaggagataattataaagtccagcaggaagtaaaaaacgtaacacaattaactgcaaattttcttaagttaaatgggatatcttatccatgaaatggaagtttcagtatcttaatttcttggagttaaagaaaaatcttttatgactttacacacacacacacacacacacacacacacacacacaagtttaagtttaaatgcggttaactaatataatttaatacaaggcatgtcaaggcaaacagctagtaaagaacatcagt

SEQ ID NO: 85 - DNA, 661 bp, Homo sapiens
  EIF4G3
  misc_feature [331]..[331]: Chromosome 1, SNP identification no. = rs11302414
  misc_feature [331]..[331]: allele = a, in linkage disequilibrium with rs2320590, respectively
  misc_feature [331]..[331]: n is a, t, c or g
cctcaccagatgggacagctgtgagatggatgagactagactatgacaacttgggacgtaaacagaaaatgcaatcctgccaaatttcagaccccaacttcaccctcccagcacaaaaaaaaaacaaaaaacaaaaacaaaaaaaaaccccataacaaaataaagaaaatcaaacctaaaacaagaagcaagagtagtctggggtctgctagtcttgcacttgttttagggtatgtaatggaatgttatgtgtgtgatttttagtaatggggtgggtaatggtcactagcagagcagatggcaaaaattgtatagaggatagtatctgaanagtttatgaccacagaaaaatggctgacaactacagacaatttcctccttaatattcaattataaaattgaaagggagtaaaaagaagcctcgaaatttatcttttaaattcaaatttatctgaaagggatatctcacttcaagtttaaaataaagaaaaatctaaacccccaaattcttcctgactaattcccaatagagaacacccacccaatttgttattcttttccccactatgcctggcagaaactgccatgctaggttagactttcagagaggaagcaatcaatgcatttctgttcatcagccaataaatggatgtggtcaaaa

SEQ ID NO: 86 - DNA, 661 bp, Homo sapiens
  EIF4G3
  misc_feature [331]..[331]: Chromosome 1, SNP identification no. = rs12130664
  misc_feature [331]..[331]: allele = t, in linkage disequilibrium with rs2320590, respectively
  misc_feature [331]..[331]: n is a, t, c or g
tcacaatgtatgccattataccactagcaatatggaatgcttaacggtggcacatgacaaagaaattttgccaatagatcattcaacgatcgttcagagcatttttccattctctgtggatgcctttagaaacttcttaggaacagtatgacttgttacctatcattgctgtaagcagtgcaactgtaaaagatgcctctactcttttgatctcttctctgcatttaatgacttattctagaataatttccttaatttactaccatgctttgttgaaaaacaatgcaaaatttcagtgggaacatactttgaccatgtttcatgtcaaatncacagaaaactagggacagatcaatgaaggatcatttcaataataatcagagcatctgtttgtactttcccttttcgaataatttcaaagtcatcccaaatatttacttcttcaaggacatatgggtgaacatacagaatttactctgcaatccagtatactgtccaagttgatgagttacagacatctgttctcactttcattattaattttatgtttcaataaacctttttgaatgctttttatttgttggggagataagaacacaatagtgacagcaaaccaagcaaatgatgtaaattaataatgttactgaagaaaagccaatga

SEQ ID NO: 87 - DNA, 661 bp, Homo sapiens
  EIF4G3
  misc_feature [331]..[331]: Chromosome 1, SNP identification no. = rs6661116
  misc_feature [331]..[331]: allele = g, in linkage disequilibrium with rs2320590, respectively
  misc_feature [331]..[331]: n is a, t, c or g
atcagttgaacccaggaggcgaaggttgcagtaagctgagatagtgccactgcactccagtctgggtgacagagcaagactctgtctcaaaaaaaaaaaaaaaaaagaaaaagaaaaagaaagaaaaagaaaagaaaaaagaaaacatgtaacaaaatttactatcttaaccactaagtatacagtactgttaactatatgcacatagtacaacagatgtctagaactttttcttcttgcaaaaaacaaactctataaccactgatttccatttaaattgtatttatatacattttaatccttagaatgtaaatagccacatacatagccnatggctaacatactgcacaacacaggtatagcaaactgttaattcccatgttttgcttttatgagttctatattttatatcactctaaacttctgcaactctactttcatagaagtacaataatatccaacaaacaagaccacaatataaaacgctggagacagtgacagagacctatcactgaatttcctacacagtcttaagcatagcacttgttttcctcagctaataaagactgaagctttaagctactgattatcacagtgtggtccacagagtcctgggcatctctgtaatgctattaaagcaggtgtgggaggtgaaatattt

SEQ ID NO: 88 - DNA, 661 bp, Homo sapiens
  EIF4G3
  misc_feature [331]..[331]: Chromosome 1, SNP identification no. = rs12070677
  misc_feature [331]..[331]: allele = g, in linkage disequilibrium with rs2320590, respectively
  misc_feature [331]..[331]: n is a, t, c or g
taaccactaagtatacagtactgttaactatatgcacatagtacaacagatgtctagaactttttcttcttgcaaaaaacaaactctataaccactgatttccatttaaattgtatttatatacattttaatccttagaatgtaaatagccacatacatagcccatggctaacatactgcacaacacaggtatagcaaactgttaattcccatgttttgcttttatgagttctatattttatatcactctaaacttctgcaactctactttcatagaagtacaataatatccaacaaacaagaccacaatataaaacgctggagacagtgncagagacctatcactgaatttcctacacagtcttaagcatagcacttgttttcctcagctaataaagactgaagctttaagctactgattatcacagtgtggtccacagagtcctgggcatctctgtaatgctattaaagcaggtgtgggaggtgaaatattttcgtaaaataaatactaagatgtcacaggcctgtgctgatattttcaacaatgatagaaaagcaaggtggatgtagctactagtaaatcttaaatatatactcaggaaatctgagatttcactaagtaaatcttacatatacttagtgaaaaccaaggcaatgatag

SEQ ID NO: 89 - DNA, 661 bp, Homo sapiens
  EIF4G3
  misc_feature [331]..[331]: Chromosome 1, SNP identification no. = rs6681064
  misc_feature [331]..[331]: allele = g, in linkage disequilibrium with rs2320590, respectively
  misc_feature [331]..[331]: n is a, t, c or g
agaaagaatccacagatcctctaaaagaagtggcacgccgctgtaaattccacaagacaggtgagaaaccgtgagttccccaagtgtaaaagcaggaaaacccgcctccgaacacacattcccactgaaaaaactgaaaatccagattacaggagaaggatttaaccttacctagaactaaagcagatttagtgcggaatatgaaagtagaagcagtagcaagaagagctttgtaagcactcacattctccagctagagtccagggaagctatccctgactatatctcagaggggccctcagggaaggaagccggcagaatctgggagggntcacagtgtgaaagaagctgccaactcaactgtgtaataatttcaaccagacgcaaactctctcaagcagttaagaatctgcggcagccaactaaatgccccatcgagaaaaagccacactcaaaacaatataggaaattttttaaaatattaaaataaagaacaataatttgtaaggcagccacagaaaaaatttttttaatgtatatatgtatgtatatttagaggttgcccttgctccaatccctcctcattgaggccaagttgggaggaatccacctaattctaagatgctccatcatgacagaaggaaaagagtggaacttgttt

SEQ ID NO: 90 - DNA, 661 bp, Homo sapiens
  EIF4G3
  misc_feature [331]..[331]: Chromosome 1, SNP identification no. = rs6659152
  misc_feature [331]..[331]: allele = g, in linkage disequilibrium with rs2320590, respectively
  misc_feature [331]..[331]: n is a, t, c or g
aattactggcttgagccaatgcgcctggcccaaacaaagtctcgctctggggtacagtggcgtgatcccggctcactgcaacctccaccccctaggtccaagcgattctcatgcctcagcctcccgagtagctgaaaccacaggtgcacacaaccacacccagctaatgttttatattttttagtagagacaaggtttcaccactttggctaggctggtcttgaactcctggcctcacgtgatccgcctgcctcagcctcccaaagtgctggaattacaggcatgagccaccatgcctggccccaatcataaagttttaattagactccangaacacaggtaatggaatttccaaagcagagccatccatcctgggagcaagaacagaggaaaagacctgctgagttagattcagggacgagaactgggaagaaagagaaattgagtcgggggggggaagggaactagtgggccaggtgcagtggctcacgcctgtaatcctaacactttgggaggccaaggcagaaggatcacttgaagccaggagtttgagacaagcctgcacaacatagcaagacctcatcactacaaaataaaccattagtttgatttttttaaaacaaagagaactagtggttttataaaaataaagttatagtag

SEQ ID NO: 91 - DNA, 661 bp, Homo sapiens
  EIF4G3
  misc_feature [331]..[331]: Chromosome 1, SNP identification no. = rs6426658
  misc_feature [331]..[331]: allele = a, in linkage disequilibrium with rs2320590, respectively
  misc_feature [331]..[331]: n is a, t, c or g
agtcacagtatgtgttttattctacattacgaccatccaattattcttactctgttacttcaaaaacagatatttaatgagcagtactctacacaaattgaagtacactttaatattattcatcacccattcaacagctgtatttgtgatgccattctatcaaccaaactctaaaaatatttatcactataaaacagaattatagtatgagacaattttgccaagtaaaccaatttcacataatactctgtaaactgaaatactatcttagtgattgcagtgatggaccatacaaagtggctgctgacatggcactggcagaggtggggtncggccgcaggccacaggtgctcaggtatagacaccaaggcgaatggtacatggggcctgtggccctgggatggtaccaggttcccgtacttcggcagtaggctcagattggcaccaccggagatcgtgtccccaggatctgccccatgtcagggtgtctgctgagcctggcactcctggtggctgggcctgggcccagaatctgctcccagaggcgccaccctggcagggtcgtaagccaggcaagggggagccctggggctgcagggggaccctgcaacgacatcacccctgccctggatgccagtccaggcccggtgagggcctggag

SEQ ID NO: 92 - DNA, 661 bp, Homo sapiens
  EIF4G3
  misc_feature [331]..[331]: Chromosome 1, SNP identification no. = rs6685914
  misc_feature [331]..[331]: allele = g, in linkage disequilibrium with rs2320590, respectively
  misc_feature [331]..[331]: n is a, t, c or g
cagcccagccaggtatgcataggctcagggcagcactgacccgctgggtcccttccagcttggcccctccaaactttgggtgccaaagaccacaggagagtggccaagatagggcaggggggcagttcagcgatagcctgtgggcatcccttggcacaagtaacctgggggccataggcagtggtgggaggcaaatgggctcctgtgccagaaggggcgagtcctcagtgaggccccaccttttgccagggaggttctgaaggctaggggtgggctacccatcccatggaccagagtggggacttgtggtgccttttctgggctgcccacngaccaactggcatgcaccacctcccctgtaaggcccataaaagcctcaggctcaaccagagcagggcagaggaaggagagacatcaggatgaccagctgtagagaggagctaccctctctagggcctcctctctgctgagagctgcaaacactggaatgacctgcctacagagagaagccacctgctccagggcctcctctctggctgagagcaacagacatcaggacgaccaaaggcagagaggagccacccactgcaggcctcctctctgctgagagctgcagagacaatgggacaacctggctgacgagaggagccacccactctag

SEQ ID NO: 93 - DNA, 661 bp, Homo sapiens
  EIF4G3
  misc_feature [331]..[331]: Chromosome 1, SNP identification no. = rs6684976
  misc_feature [331]..[331]: allele = a, in linkage disequilibrium with rs2320590, respectively
  misc_feature [331]..[331]: n is a, t, c or g
aatttaactgtgttgttattacagttctgttaaagcgaactaaatatggtctgagaaggactccgtacttttaaatctgagtccctgtggatgaaccctaactcagcttaaaaggcagacaagactgaaaacctaaagagtatgcagctgtaaaaacagctgagtcttggccaatcccagcagccatacttcaaccaatcatagactgctgagtgttcaaacaaggcaaacgtcaccctgtaaccaattcaggtgtttctgtacctcacttctgatttttttttttaacactttccctttttttggtctataaatttgttctgatcagaangtacccctagagtctctatgaatttgccgtgattctgggggatgcctgcaccagtcattcactgctcaattaaactcctttaaatttaattcgactacattttaattttaacagttatgaatatgtttcacagtccagatgtcttatcacatttactttgtatttcccctttcctgactttctctcagggatgtcagctgctttctgcagttattaatctctagattacctccgcatcctcctttttatttttattttttgtagagaccaagtctcactatgttgcccaggctcatctcgaactcttgggctcaagctatccttccacct

SEQ ID NO: 94 - DNA, 661 bp, Homo sapiens
  EIF4G3
  misc_feature [331]..[331]: Chromosome 1, SNP identification no. = rs6668370
  misc_feature [331]..[331]: allele = t, in linkage disequilibrium with rs2320590, respectively
  misc_feature [331]..[331]: n is a, t, c or g
gtctgctcacttcccccacaacacgctctgaatcacatatacatttttgcaggaactatcacaagcactttaaattgaagagtcaaactgcacaatttcttcattattcttaaaacttacctgttctgtttctcatcctaaaatttactgacacatgctaatctctgcagctgaactgaattagcaattttcagaaccataaaaatctaaaaatctgaatgtcacaaccagataaaaaataaattagtggcactaaagtgagtttttcccccaaatctgtgggaaataaatgaagtgtgatattcccaagaggtaaactggcaagaaaaangctgacagagtttttcatgacttcttaaaacagatgagaggtagccagagaaataaacaagagtctcccaggatgcatccaaaagaaacagctgttcaaatgtaaaagacaaaatcctaaaccttttgcctttgacaggatttaagtgaaaatgaacatcatcaacaaaagactgagcctacataaaacagaagtaaagaaatgcttacaaaatcacaatcagtttggttcttacaaaattctttagcttgctgtaatagtgctgaattaatacttagataaaatgtgggttccagccatgtgaatttgccaaacagaatgtaaaactta

SEQ ID NO: 95 - DNA, 661 bp, Homo sapiens
  EIF4G3
  misc_feature [331]..[331]: Chromosome 1, SNP identification no. = rs6703227
  misc_feature [331]..[331]: allele = c, in linkage disequilibrium with rs2320590, respectively
  misc_feature [331]..[331]: n is a, t, c or g
cattagattaggcaaaatggtggcaaaacagaccacaaaagaatgcaacacaatatttggtggccattctccctggtattcatgtactctggtttctaaaggcacctggtaaaatggcatatagaacagcacttgaggatttaacaagtgagatgctaggagaccatcttttcttaaatgcaaactatgcatttgcgagcagcctatctttcagaaaacttaagtcctttgggccaactgcttgggtcaaatcacaacttgaaacagtaagaatttcaaatggaaaactaagctatttcccttacatgccagttatcaactgcttgtcttncatatcaaaattcactgtttgcctgtaataagaaaatggatctgagctctataaatattttaacatttcagctgacacaacattaagttttgtcagtagaaggctctagagatatgtagaaggaaagggttttgctccctggttcctggttcctggttcctggttgctcctgcagcccagatagcttctccaaaagatggcttctctagtgactagctcccctcatggacatagcttcatcagagcaagatttctgcttcagtgcacagcaagcaacagtacccagcagccaagagctacccctggtattccctcaggaagacacgcagc

SEQ ID NO: 96 - DNA, 661 bp, Homo sapiens
  EIF4G3
  misc_feature [331]..[331]: Chromosome 1, SNP identification no. = rs964466
  misc_feature [331]..[331]: allele = t, in linkage disequilibrium with rs2320590, respectively
  misc_feature [331]..[331]: n is a, t, c or g
ctgtaataagaaaatggatctgagctctataaatattttaacatttcagctgacacaacattaagttttgtcagtagaaggctctagagatatgtagaaggaaagggttttgctccctggttcctggttcctggttcctggttgctcctgcagcccagatagcttctccaaaagatggcttctctagtgactagctcccctcatggacatagcttcatcagagcaagatttctgcttcagtgcacagcaagcaacagtacccagcagccaagagctacccctggtattccctcaggaagacacgcagcacagtggcttttctaagaaaccnccctgcgaacagctttccctcggcaccctagagggcagaattctcacaagttctgagggtggattttcagtaacttccactgaaatggcaccactcccattcagaaagccacaccgtgccctctccaacaaggtcaagatcttagcccagggtaggggtagcagtctctcacctaaaactaccacaaaaaataagacgtaggtttggtaggccttttttggatgtagaggcaacatatatactacatctgaatgtgccaccttaaccgactacagagtcacctaggaagtttccaattttgagtagggaacacaatatacgaaggttata

SEQ ID NO: 97 - DNA, 661 bp, Homo sapiens
  EIF4G3
  misc_feature [331]..[331]: Chromosome 1, SNP identification no. = rs10493006
  misc_feature [331]..[331]: allele = a, in linkage disequilibrium with rs2320590, respectively
  misc_feature [331]..[331]: n is a, t, c or g
tgtgggaaacagatatgcagtaaggagccttttagccattgtgccctgcatcagctcttggctataagagattggtgctggagaagaaagctttccccaatacttcatagggcacatttccagcaagttccagaacaaagagtttcagcaagttctgaacagcaccacagtggctcttctaccacagcctttggctcaaccctacagagaaaggctccctatctgagcctctactcagccctaaggtaagcgtttgctctttatatcttatattcttgagagtgcatagtttttctctcctgattagactcagattaatacaccttaatantaagttgagaggttgtgttcagtctaagaaacccaacacaggaacctcatttaaacaatcaggagctcattttgttttgttttcaatgtttaaaactccaaattatataggaatgatttagactaagtttaggtatagcactaagttcttgacaaacttatattcattaatagggctatttcagtcatggtttggcaaactgtacattccttttccaaacattctatagtctaaaatataattaatcagcacatggccaggagatcaaggccaatctgagcaacatagcaagaccccatctctacaaaaaatttaaccaaaagaaaaaaa

SEQ ID NO: 98 - DNA, 661 bp, Homo sapiens
  misc_feature [331]..[331]: Chromosome 1, SNP identification no. = rs6426665
  misc_feature [331]..[331]: allele = c, in linkage disequilibrium with rs2320590, respectively
  misc_feature [331]..[331]: n is a, t, c or g
accaaatttgcccatgacaattaaatcatagtaaatttttaaaatactattgataaaaaatattaaaatacattgtatgtttatcaattaaactaacaaaagtaagttaaaataaaatctttgccccattattggcagggatctaaggaaacaggacacagataaaatactgtgaatgggttactttactatcttcccaggattacagagcaatgtgtcaccaagtgcttcaaaaccatcaccccaaaattatttcactttagagtacataccctaaagaaaatctcacctcaaaaattaggaacttaaagatatatccagtgcatttcanatgatggcaaaaacaggtagaaatagcaaccaatgagaaaatgaagtaacacaactgaactaaatacataaaaaatataaacctgtacactagtatcaacagaaatatatgaaataattaggaataataaaggaaaaatacatctgcagagttgtaaagactgtaagctatgtttcttacagaactgtaaagaggtactgacatatactaaagaatactgaaagaacaatttaaattattacacataaaattagtatccattggtttgtcagaaaactattatattgccccataaaacacaaatgtttgagagaaagagaaaaagcattg

SEQ ID NO: 99 - DNA, 661 bp, Homo sapiens
  misc_feature [331]..[331]: Chromosome 1, SNP identification no. = rs10916927
  misc_feature [331]..[331]: allele = c, in linkage disequilibrium with rs2320590, respectively
  misc_feature [331]..[331]: n is a, t, c or g
tgtttttattctatatattttatataatatgaatgaaaacatactgctttaaaaagtatagtaattaatcagttactaaaagaataacaggaaactccaggattcctatcaagtaaattaatttttcagcaacaaatgattcctataaaggtaaaaggcacatggtttatatgtgtgacatcccttattttctaaatcccaagataaagtttatttagtgaggtcatctcaaaacatttcagcagctgcaactcatacacagaaataacaaagttcaattctgggtagttttgaaagatcccaaagcttttcttatgtgggtaatttctanactttatgctcctcaagcagcagaatagataagtcaagtatttttcccttcattaatattttgtatcatcctagttcttccttcaggtcatttatttccccaaatctacagatattgagaactaaataaaagctggtctgctcaactaaaaggagcactacagtggatatgaggaaggaagttttacttatacatgacaccatttgaattctgttaatatcattgccaatccccaaccaccaagaaaaaaagagaaagaaaaagaaaatggcattcctccttgctctactcttacctatacttaataggttgaattacatgaaattccag

SEQ ID NO: 100 - DNA, 661 bp, Homo sapiens
  misc_feature [331]..[331]: Chromosome 1, SNP identification no. = rs6658526
  misc_feature [331]..[331]: allele = t, in linkage disequilibrium with rs2320590, respectively
  misc_feature [331]..[331]: n is a, t, c or g
agccagggctgctttacagcgtaaagggaggaagccaagatagtaaaaacatttttatttctttcactgctaatagaatcgtgtagcactatattatgattccaaggtcctttcccagttcaacagcaaaaccttgatcagttaggaatgactgtcttgaataaaaaaaaagagtggtaaggtttgtctattctactaaatccaatcatttagtaaaactacacaaaattagtaacagtctacacaagcataacaaattaactccttactttttcaaggaatacatatattacaggccaattgctgtccttgtggtcagaagcaggaacanttgacaactcctcagaagatgtggagtgaagacttttaacatcatctgaggagtgatggcttttaacagacactcacattctctttcttatgttcaaaatccatagtcagagctttccaccaagacaaggttgtatgcgagtctggagattactgatatacattcagtgactgcaatggaattagtcatttaccaacttacaacttaattttttaaaactaatgccttactattttcctgttgatcttcagtcagttgctaatcaactagttatttaactgatccaaggtaagtgaattctattttaattccaaggtattaataaatctc

SEQ ID NO: 101 - DNA, 661 bp, Homo sapiens
  misc_feature [331]..[331]: Chromosome 1, SNP identification no. = rs1354792
  misc_feature [331]..[331]: allele = c, in linkage disequilibrium with rs2320590, respectively
  misc_feature [331]..[331]: n is a, t, c or g
tattttcctgttgatcttcagtcagttgctaatcaactagttatttaactgatccaaggtaagtgaattctattttaattccaaggtattaataaatctcagattttagtattcaactataagcataaattcaattatattatcaaaaccacaatattaagttcctctgacacagatccaaatcatgtaagatgtgtgatatatgcctccattctgaggctgagtcacgaattatcactttccaaacacaaacttgaaagaaggaacataaacagaaggtaaacagattcaaggcatccaagtaggctaaacagcatcaataaaagagcanggggttgtttctaccaaaaaaaaaaaaaaaaaaatttagcatggtggtgtgcacttgtagtcctagctctagggaggctgggagagaaggattaagcccagaagttgcagcaagctatgatcatgctactgcactccagcctgggagacagactgaaactctatcttaaaaaaaaaacagtggtggggcggcggggggaagaaaaaaagaaaaaaatgagaatgggttttggtgtcagagacctaagtttgaattctggctctactatacagaaactatataagcaaattacttaagtttagtttcctcttctgtaaaagtgaaaagtaa

SEQ ID NO: 102 - DNA, 661 bp, Homo sapiens
  misc_feature [331]..[331]: Chromosome 1, SNP identification no. = rs12567861
  misc_feature [331]..[331]: allele = c, in linkage disequilibrium with rs2320590, respectively
  misc_feature [331]..[331]: n is a, t, c or g
agtgagccgagatcgtaccactgcacctgcactccagtctgggcgacagagtgaaactctgtctttaaaaaaaaaaaaaaaaaaaaaaaaacagaatacttcacatgaacttgtagattcaaaacagacctgtattcaaattacatgtctccaagtcccattttcctttgttgtaaataaaggttgtcataagtattaaataatatcatgaatgtaaagcatttagcacagtgtctgggacactgtagtcactcaataaatgttaaaagatccaccaaagttcaaatccaacctctaccacacactacctggataactttgggcaggatangtcacctctgtgtctatttgccaactaacaatggggaatgtaattatacctacctcatacagttgtcataaggattgagttaatacacataaaatgcttagaaaagtaactgttacacagtaagtgttacttatagtaataaagaaaatgttctacagattgagtatccctatctgaaaaatttggaaccagaaatgtttcagatttcagattttggaacacctgcaaacagttaccagttcagcacccccaatctgaaaatccaaaatctgaactgctccattgagcatttcctttgagaataatgctggtacacaaaaagtttcaggt

SEQ ID NO: 103 - DNA, 661 bp, Homo sapiens
  misc_feature [331]..[331]: Chromosome 1, SNP identification no. = rs10916930
  misc_feature [331]..[331]: allele = t, in linkage disequilibrium with rs2320590, respectively
  misc_feature [331]..[331]: n is a, t, c or g
agcacagtgtctgggacactgtagtcactcaataaatgttaaaagatccaccaaagttcaaatccaacctctaccacacactacctggataactttgggcaggatacgtcacctctgtgtctatttgccaactaacaatggggaatgtaattatacctacctcatacagttgtcataaggattgagttaatacacataaaatgcttagaaaagtaactgttacacagtaagtgttacttatagtaataaagaaaatgttctacagattgagtatccctatctgaaaaatttggaaccagaaatgtttcagatttcagattttggaacaccngcaaacagttaccagttcagcacccccaatctgaaaatccaaaatctgaactgctccattgagcatttcctttgagaataatgctggtacacaaaaagtttcaggttttagaacatatcagattttgaatgttttgattagagatgctcaacctgtataaactgttctgttgagtttttcaccagttaactcctctgcctaggtttggtcaatttttgttatctatttcatggctcattacactatgtagctgtaaccttatcctccacctcaaaggctttaactgatgtatgtacactcattccaatatcttgtaagatgcagtccaaa

SEQ ID NO: 104 - DNA, 661 bp, Homo sapiens
  misc_feature [331]..[331]: Chromosome 1, SNP identification no. = rs6426667
  misc_feature [331]..[331]: allele = a, in linkage disequilibrium with rs2320590, respectively
  misc_feature [331]..[331]: n is a, t, c or g
tgtacttaaaacaacgtatcaccatcttgcctggtaaaatgagcactcttaaagacaaggatcatagtgtccaccactgctttctcacattaccaggcacaaaaccttgcatatagctctcattcaatatatgttttctaaattaagtttatctcaatattcttaaaagctctgcaacatctccaatgtttagtcccctggaaaagcaagctccaagaggccagaggatctttcagttattttgtacttaggaaaacacagaaaagtaacttcaaacacattttaggctgtcacaacaggaaaggctgttctctatttagaaagaaaggcnaaacagaaaaaagactgagtctaactcgtaggaatttttaccgggggagaggagggggtaggaaagcagcagcagcatctggatttcacaaatatttgatgacactgactgtgaggtttgtcgaaagaaaagaggatgagctaatcatgggtaagaatgagattttttttgttgttttacgtaaaaggtgagcacaggaagaatagagaaatgaaatatactcaatcatggttatcttataaatcattatagaattcagtcaaagatgatctttcaaagtaatgcaagacttgaactcagctaactgtcctatattaaaattttggaaaa

SEQ ID NO: 105 - DNA, 661 bp, Homo sapiens
  misc_feature [331]..[331]: Chromosome 1, SNP identification no. = rs6426668
  misc_feature [331]..[331]: allele = c, in linkage disequilibrium with rs2320590, respectively
  misc_feature [331]..[331]: n is a, t, c or g
aggagggggtaggaaagcagcagcagcatctggatttcacaaatatttgatgacactgactgtgaggtttgtcgaaagaaaagaggatgagctaatcatgggtaagaatgagattttttttgttgttttacgtaaaaggtgagcacaggaagaatagagaaatgaaatatactcaatcatggttatcttataaatcattatagaattcagtcaaagatgatctttcaaagtaatgcaagacttgaactcagctaactgtcctatattaaaattttggaaaaataaatttaagaccacaaaggaaaacggcaagccacaacttattactgcnaatacaatattatttttcaataatctaggaaaattttaaggccactgtggaaaaccatttgcatctagtgattgaatcaggatagaattattaccaatttgcatatcaggcagtggcaactaagactgtggaaaaaaaaagtttgatgcttactttctctaattgctacaataatgtataaacatgatttttgttaaaaaaaagaaaaagtagtgccctctttacccttcaaatcccactccactccctatggcaaaatgattaatactctgaagcacattattacaaacctttctatacacttacaaatgtgtaaaaataatagcaaca

SEQ ID NO: 106 - DNA, 661 bp, Homo sapiens
  misc_feature [331]..[331]: Chromosome 1, SNP identification no. = rs6692244
  misc_feature [331]..[331]: allele = a, in linkage disequilibrium with rs2320590, respectively
  misc_feature [331]..[331]: n is a, t, c or g
agaccacaaaggaaaacggcaagccacaacttattactgctaatacaatattatttttcaataatctaggaaaattttaaggccactgtggaaaaccatttgcatctagtgattgaatcaggatagaattattaccaatttgcatatcaggcagtggcaactaagactgtggaaaaaaaaagtttgatgcttactttctctaattgctacaataatgtataaacatgatttttgttaaaaaaaagaaaaagtagtgccctctttacccttcaaatcccactccactccctatggcaaaatgattaatactctgaagcacattattacaaanctttctatacacttacaaatgtgtaaaaataatagcaacaacacaataataaatattcaatgacatgttttcctctccacttatcaaaacattagagatctttccaagtcaataaacatacctacttcattcttgttctaaatgtttaagtagtacttcatggtgtagatataactacattcttcttaactattaattttttaaaactccttaatgaaaagaactatataacctactaacattttaagagccaaacatgtatgtgcaaacataaaataaaaaacaaactaccttctttttgctaagtttcagatatgtcaattaatataa

SEQ ID NO: 107 - DNA, 661 bp, Homo sapiens
  misc_feature [331]..[331]: Chromosome 1, SNP identification no. = rs7521711
  misc_feature [331]..[331]: allele = g, in linkage disequilibrium with rs2320590, respectively
  misc_feature [331]..[331]: n is a, t, c or g
agtgctcaaaaggaaatgctctactggacagcacggttctgagccaccaatcatcaggaggctcccaccttaaggccttggagctctgcaatatctattgggaaggtttatgctcttcctcttcatccatgaacagctgaatacatttcatggttcaggtatcacctaaaatggcatcttctcacaggaactgtaggcctcacagcatggacccctctaagtctccctgggcacacgccacatgcagatttcggtgctttcccaaccttcttggtataaaggtcgacaattctattaccaagggctcatgacagcctagttttgttagagnctgtattgtagggaagtctatgatggtattgtcacatgctggatcattctgagtgcctgtagacaacgtccctggaagagatatttttattttttaatggagacaggttttcactttgttgtccaggctggagtgcagtggtgtgataatggctcactgcagccttgacctctgaggctcaaatgatccttccaccttctctcatatcttaacagaaatgatcagttttaaatcttgtttctctatttctaaacactacaattttcattattttttactttcatatgtttttctaccaccatctagtagagtaccatagatggtattgaa

SEQ ID NO: 108 - DNA, 661 bp, Homo sapiens
  misc_feature [331]..[331]: Chromosome 1, SNP identification no. = rs1567128
  misc_feature [331]..[331]: allele = g, in linkage disequilibrium with rs2320590, respectively
  misc_feature [331]..[331]: n is a, t, c or g
agatcacatcattgcactccagccagggcaacaatagcaaaaactccgtctcaaaaaaaaaaaaaaaacaacaaaaagacactgccgagaaagcagagaaaggagaatgctcgcactgctgctgggaacataagttagtaaggccactaaggagaacagtataaaggttcgtgaaaaaactacaatagatctaccatatgatccagcaatctcactgctgggtacatatccaaaagaaaggaaatcagtgcattaaaattataagtgaattctacagcatttagaatttatagcattcatttatttattaatgaattcagtgcagagatanctgccacccgtgtttactgtagcgctattcacaatagccaagatgtggatcaatgtaagtatccatcaacagaataatggataatataaatgtgtcatatatacacaatgaaatatcactcaaccacgtccatttgcaacaacagaaatggaagaggaggtcatgatgttacatgaaataagccaagcaaagaaagaaaaatatcatgtctttactcctatgtgggagttaaaaaaaaattcatctcatgtaggtacagagtagaatgatggttaccagaggctgggaagcatggaagggtggtgagacatatgaagactggttggttaa

SEQ ID NO: 109 - DNA, 661 bp, Homo sapiens
  SSBP3
  misc_feature [331]..[331]: Chromosome 1, SNP identification no. = rs4601533
  misc_feature [331]..[331]: allele = c, in linkage disequilibrium with rs10489565, respectively
  misc_feature [331]..[331]: n is a, t, c or g
tacagggactagaaaccgaactggacccagatccagggctgtcagtgactgaccactcccccggctcagcaagagcactcctacatcccaatgctgcaccaggatgcccaacaaaagatgggactcccatttcactatctgcaacctgatcttatctagaaagcctggagccagcgcataccactgtctgcagactctacagccttacaaggctgcctgtctgctctgctttctgcagcatcagtgcacctcccagcccctcaaactcctacccatcaaaaccacatgccagcctttcccaggcacctgccacatgcagggcaggtggacngaccagcaatgacacggtacagtgaggcaagtctttccacccaatcccacaaaacataagccaatgctgggaccctcaatggactctgagggtcaccccactgaacggcaaacccgagaactacaggagagacacgaggcagtgggtgaagtggggaggtggccctgctggatcctagagccccaggagggtacacactaccactcttgtcatgtggttctcggcgttcacatctaacgtgggagcaaggaacttccacaaagacctgctgggcctctaacacacagacctctcccccaggagcttacaaccgagatggggagggggagt

SEQ ID NO: 110 - DNA, 661 bp, Homo sapiens
  SSBP3
  misc_feature [331]..[331]: Chromosome 1, SNP identification no. = rs10489565
  misc_feature [331]..[331]: allele = t, c
  misc_feature [331]..[331]: n is a, t, c or g
cggagggttttacaaccctaatgtcctcactcggtgacacggaccggtgtacataatagaatgttaggtccgatactggaccccgtaccagggggtaaaacgtccactcctttaactctgagctcctccaagtcattgaaggggttcaagtacacaggattcgtttcgacaatggatttgtaaaacccgaaatttaaacccaagaaaaaaaataccgtggtgtgacggaggatcaaagaaaccacctttgtgaacccccctgggtacgtccgaaagacactagtttcggtaagggtccggtcaaatggacccagtgtccgaaagtctatgnaatcttgaccgacccctggggactcggggaaggtcgcgacaataagacatcaactcttctctacaaaatctctcacttcactaacggttctaacctgtctcttaaacaaacgattaagaaaatccataaacaactcacggatagcacacggtcataatcttgtgtactatttcgttacttgttttctgtttgtaagactagaagcccctcgagttcacctccaaaggtataaagacacgagattgaaaggagaaggagggattcgaagatctgtcgagaaaacagggagacacctgagtcccttacgtttcattaaaatcatattacaaa

SEQ ID NO: 111 - DNA, 661 bp, Homo sapiens
  SSBP3
  misc_feature [331]..[331]: Chromosome 1, SNP identification no. = rs12024740
  misc_feature [331]..[331]: allele = g, in linkage disequilibrium with rs10489565, respectively
  misc_feature [331]..[331]: n is a, t, c or g
tcccagtgtctttggtgttcttcctgatgttcttagcactgtgccgtaagcacacatggtcctgagacccaaatgctgtaataccccagggctcagtgattgaaaagacagggccaaccccctctccagtggcggctggatgggagaggagcaacaagactgctgccagaagaccacccaagggggggtatgctgaagggccacgagaaaggtctccaaacaccccaaagctacagacacttgttccactgcattattttcatagccatatcaggtcgccctgcaggcaaacactattctcagataggagctgcatgttctcacaagactnagttgctcagagttaagattaggtttagagcgcattaactccagcaccgaggaacactccattgtggactgagtagacactaccatgagctcaagcgcccaagtggaagaaagcgtgtgtggatgccatgtgtgcatgaacatgtcacaccttacatgatgacttgcttcagaaggctggctctggggaaggcttgggcgattttaagccttgtttgccaacacatagggagtgcctgctggggccttcctctactgtgacacgggcacaggaatgggagagagacacacccagtttggtgtttcagtgtgtctgcaatgatggtgcctc

SEQ ID NO: 112 - DNA, 661 bp, Homo sapiens
  SSBP3
  misc_feature [331]..[331]: Chromosome 1, SNP identification no. = rs2073108
  misc_feature [331]..[331]: allele = g, in linkage disequilibrium with rs10489565, respectively
  misc_feature [331]..[331]: n is a, t, c or g
gtgcctgggccctcttcctggtgtcacccgcataacctcctggcacagacactcagctgccacctgacagcattgcttcaccttcttccctcttcccctccagggcccccagaaccaacaggggaagttggttgctaatggcaacagtcttgggagcaaggtgagacctaccagcccaccactgacggctgaagggaaattttcaacagcctctggggcccctttctgtcaatcaagcggcctcttccctgtctgggactcggtttcctcttctataaaaagcgagtgccacccttcatgattctagttacagagttgagaagggttacangaatccagccaatctgggcctctggggctgccctggatggatttagaagggtcagcaaagagttgttttgaaaaaaacagcaacaggctgggcgcagtggctcacatctgtaaccccaacattttgggaagctgaggcgggtggattgcttgagaccaggagttcaagaccagactagacaacatggtgaaaccccatctctataaaaaaaaatacaaaaattagccatatgtggcggcgcatgcctgtagtcccagctacttgggaggctgatgggggaggattgcttgagcccgggaggtggaagctgcagggagccgagattgcacc

SEQ ID NO: 113 - DNA, 661 bp, Homo sapiens
  SSBP3
  misc_feature [331]..[331]: Chromosome 1, SNP identification no. = rs17101278
  misc_feature [331]..[331]: allele = g, in linkage disequilibrium with rs10489565, respectively
  misc_feature [331]..[331]: n is a, t, c or g
aactgacaccaaacacctcacattctccaggatgaaatttgttcacaaaccaccctcaactatcctataatggatgcttacattatccccatttcacagaagccaaggtgaagaagcaagtcaatcagtgaagcctgttcaggtggaacaagctgtccccatccctttctccctccatcccccaccccacctggcaggggacagaatgcaaagcaaatccatgctaaccacacacaaccctgaccccaagaacccagacagagtgtaaaatgcagaccccacctaatccaacgtgagatatcagggctatcaacgtgagctaactgacttncagagcatgaacttgcttaaaaacattctttagttttcatttcatgaaaaggtcatacagccgaagcacaagcaccactcaggtgggcaggaggccaggggccagagagggggaggggacgagagcatcccgtgggaagatgcacaacaccccaccccgtcactgtgggagtcttggctcccaatctgtaaccttatcctggggcaagccaaaaaaggcagtagaggaggctgggccaggatatgcccctggccctgcacatgctacccgtcttctccactagctgtccacagggcctgcttctgtctctgtgtccccaggtgttgggca

SEQ ID NO: 114 - DNA, 661 bp, Homo sapiens
  SSBP3
  misc_feature [331]..[331]: Chromosome 1, SNP identification no. = rs12029610
  misc_feature [331]..[331]: allele = t, in linkage disequilibrium with rs10489565, respectively
  misc_feature [331]..[331]: n is a, t, c or g
aaaattaactgccaccattgggggctgggacggcggtttggttccttttagtccaaggcgctgacagccaggcctgcccctactagctccttctgttgtttcgaggggagtgaggcccggggctgagttaagtttcactggtgagtggccggcgggcacaaaggaaggaaccgctgggggaggggaggccgcagagctggagggctgggacaaaggggacaagagacaaagggacaggaaaagagagcccgctttatcctcctccgaggaaggaactccccatttagtcaaatatttcactcacacagctctgggcaagaaatgccccacngaacattttccgaggtggcttcaggtgtctcccacaccctccccacccaggccagacacaagacgctggctctcctggccccgccaccgcctggccaggtccccgccccaacccacttgttcatagtcagccaggttgcttttgatggcttcctccctccagccccgatctgccaccctgaagagagacaaagaattatttatttggagaaaagaaaaaccctcaaagtgtcagccagtaacagacatgacacttgctacgcaggagcgacatgcgggttttctagtctgcaggagggccttcgccagcagcacacctcggccaccctgg

SEQ ID NO: 115 - DNA, 661 bp, Homo sapiens
  SSBP3
  misc_feature [331]..[331]: Chromosome 1, SNP identification no. = rs3795357
  misc_feature [331]..[331]: allele = a, in linkage disequilibrium with rs10489565, respectively
  misc_feature [331]..[331]: n is a, t, c or g
gaatcggacaggtctggtgtctcgctcagttagggggaccttgtcaccgcaggcgacgagacgcccctcccagacgggtactggaccacaccctcggctccggcggtggttgaacccgcgggtcgggtctgggatcctctccctcctcggacctcgtcggaaagggaccgctctaaccggtgtaaggtaaaaggagagactggtctctcgggagagtggggacccacatgtccgagaaaggcgattgtctccgggaggaggtcggggtaacaggggtgacactctggtcctcacggggaaagggtcggggttttttactcacgcgagggtnacactccgtgtctcactttcggagcacaaaatcttgccgcccacccttcctgaactacgcggcacaagaacgtccttcccgtccctgctatggcggaacacgaaacggaccgtgtaccatccccggatccataaacccgcttacctcactacaggtctctttcgtcctgaaaccgagcccgttcctcacccaccgtcatccctcctgacaccagacaccttcccagtgacaccgagaaccgaaagaggatgacagggacggctaccactgtcggtcggtcggaggaccggcgtggtaacatggcggagaaagaaccgaaccaggacccgc

SEQ ID NO: 116 - DNA, 661 bp, Homo sapiens
  SSBP3
  misc_feature [331]..[331]: Chromosome 1, SNP identification no. = rs12022116
  misc_feature [331]..[331]: allele = g, in linkage disequilibrium with rs10489565, respectively
  misc_feature [331]..[331]: n is a, t, c or g
tgaggcaggagaatttcttgaacccggcaggcggaggttgtagtgagccaagatcgcaccactgcactccagcctgggtgacagagcgagactccgtctctaaaaggaaaaaaaaaaagaaagaaaaaagaaataaagaagtccctgtactacagtgtggctagaccctccctgaagaacagataagagccattcacaattagaagcaaccctgcacacagagaccacagctccaagccctaagccacccacactggaatcttgtttatccttggctaagcaaacacaagtcttcttagataatgcaaaggtcaactgtagacttgtatgncctgataaaatcgccaccaaccctgaattacagggtgttcaataataaaatatttctacagagctatgagggagagagagaaatcagaagtgggctattttccatcatcctccattaacaccccactaagacacaggctgagtgatggagttctggattccaggatcacatccctgtccacccactccccagccccctttataaaaagcaagaaccggccgggcacggtggctcacgcctgtaatcccagcactttgggaggccgaggcgggcggatcacgaggtcaggagatcgagaccatcccagctaacacagcaaaaccccatctc

SEQ ID NO: 117 - DNA, 661 bp, Homo sapiens
  SSBP3
  misc_feature [331]..[331]: Chromosome 1, SNP identification no. = rs12043222
  misc_feature [331]..[331]: allele = c, in linkage disequilibrium with rs10489565, respectively
  misc_feature [331]..[331]: n is a, t, c or g
tccgtctctaaaaggaaaaaaaaaaagaaagaaaaaagaaataaagaagtccctgtactacagtgtggctagaccctccctgaagaacagataagagccattcacaattagaagcaaccctgcacacagagaccacagctccaagccctaagccacccacactggaatcttgtttatccttggctaagcaaacacaagtcttcttagataatgcaaaggtcaactgtagacttgtatgacctgataaaatcgccaccaaccctgaattacagggtgttcaataataaaatatttctacagagctatgagggagagagagaaatcagaagtnggctattttccatcatcctccattaacaccccactaagacacaggctgagtgatggagttctggattccaggatcacatccctgtccacccactccccagccccctttataaaaagcaagaaccggccgggcacggtggctcacgcctgtaatcccagcactttgggaggccgaggcgggcggatcacgaggtcaggagatcgagaccatcccagctaacacagcaaaaccccatctctactaaaagtacaaaaaattagccgggcatggtggcaggcgcctgtagtcccagctacttgggaggctgaggcaggagaatggcatgaaccc

SEQ ID NO: 118 - DNA, 661 bp, Homo sapiens
  SSBP3
  misc_feature [331]..[331]: Chromosome 1, SNP identification no. = rs2297573
  misc_feature [331]..[331]: allele = g, in linkage disequilibrium with rs10489565, respectively
  misc_feature [331]..[331]: n is a, t, c or g
gcagcaagtgctccaagctgggagaacagcctgtgcaaaggccccaaggcagagagctggcccttctctaactacagcccaggaatctcaggcttcacattccaccctaacagaaaaatacacagatgtctttttaatgttaggtccccaaataatttttatttcaaaacacagaaatattccgttaagtccctctaaattttttttttccaacatacaaggcccatcaccttctcacctctccccattgaccacctttccatttctgcagcagttttccaagagcagtagcttctaattcctgaacagctcacatgggcctccagttgtngacacaccctgtctcctctctggctaatggtggccccagctgcctgtccacgtctccagagtaggcctgggcagggacagggaaggacatacttcctaaccaaaagaaaagagcaaaccgcaggccaggaaggaagtaggaagtcatcctgagcgcagatccctagatgaggcctgagcacagcccctgatggcaggcagtgggcagtccctccccagatggactagggaagctggcacttaggaagagaaagatcgtttggggacagggagcaggatgaaacacatccctggcccttctcaaggacatggcttgtgctggggacatata

SEQ ID NO: 119 - DNA, 661 bp, Homo sapiens
  SSBP3
  misc_feature [331]..[331]: Chromosome 1, SNP identification no. = rs4141420
  misc_feature [331]..[331]: allele = a, in linkage disequilibrium with rs10489565, respectively
  misc_feature [331]..[331]: n is a, t, c or g
aacttcgacattgggatccggggactgacgggtgacctgtcgtcgtagggacagaactccctctcggtgggatttgtagacacggagatcttgacgtgacttggggtgtgacgtacaattgtgtcagagatgaaagacctaccaaaagaacacccgactcagaaggtactatgaaaaacttcgtagtcaattttaccggaaatcgaaagttgtacgttataaatttcgacacccactaggtcttacccagtaaaaagaaactttttccttcgctgaaatgaaaaacacagactacttataccccatgaccccttggttccacgtctcttgntctcgaaaacttccaattcgtcggacccaagattaggggtgttctcgcgggggtaggtgtcacattggacacggtcaactaattggagactcggagtcacaggaatagacattttacccctaacatgagtcggacgtcatgacgaaactctattacttcgtctcgtacaatcttctataaagtccttactttcttactctccgactttccttccatagacacgaatccctcactaagaccccgtgcaaatcttcgtgcttattcattctcctcaccttacttttcgtccttcataaatacttaccacctgaccccatacaagacttaaac

SEQ ID NO: 120 - DNA, 661 bp, Homo sapiens
  SSBP3
  misc_feature [331]..[331]: Chromosome 1, SNP identification no. = rs12045400
  misc_feature [331]..[331]: allele = a, in linkage disequilibrium with rs10489565, respectively
  misc_feature [331]..[331]: n is a, t, c or g
ttaatcaactggcacaggttacactgtggatgggggcgctcttgtggggattagaacccaggctgcttaaccttcaaaagctctcgttctctgcaccttggttccccagtaccccatattcatcagacacaaaaagtaaagtcgcttcctttttcaaagaaaaatgacccattctggatcacccacagctttaaatattgcatgttgaaagctaaaggccattttaactgatgcttcaaaaagtatcatggaagactcagcccacaagaaaaccatccagaaagtagagactgtgttaacatgcagtgtggggttcagtgcagttctagangcacagatgtttagggtggctctccctcaagacagggatgctgctgtccagtgggcagtcaggggcctagggttacagcttcaacccctcgctccccacagaaggaggggtttcctttgtgcaaggaaaagcaagggctgggtggccttcctgcagtggcccatgagcctattcttaggattgacatccttcagatacattttatccttcagataaaatgccccacgggcacagcaccttatggagcggtccacatcatcaactcccaggagctggggaggatggggagatgggatggtccctctggccaatgaggggatccacactgta

SEQ ID NO: 121 - DNA, 661 bp, Homo sapiens
  PTBP2
  misc_feature [331]..[331]: Chromosome 1, SNP identification no. = rs17525524
  misc_feature [331]..[331]: allele = g, in linkage disequilibrium with rs10493889, respectively
  misc_feature [331]..[331]: n is a, t, c or g
tttcctgagggtcaaatgaagtacagttgacccttgaacaacatgattttgaattacacaggtccacttatgcatagatccacttatacagaattttcttctccctcttccacccaagacagaaagaccaactcgtcctcttcctccttagcctactcagcgtgaagacagtcaggatgaagacctttattatgactgatctccaaaaagattggcttcagtatttcatggagtgctatgaattagaatcctgagtctctatattgttaattattttagtctcttggtctacgtgtgttcctaaactgtagtagctttcttaatttagttntaggcatactacattaggggataaggtggttaagtgatattttcactttaaaagtaataaggtgtcacagaaagttatcacgagatttttttgagcagtacttcttttttaaaactattataatgaattttagacacaatagtatcatgaaccattgtgtatctatcattcagtccccaaaaccattagtaacccatagctaaaatgatgatatccacactctgcttttccacttctgttattttgagataaatttcagatattcatattgttttatctgtaaaggcttcagtgtatatctttaaagaatagggactctcctctcctttt

SEQ ID NO: 122 - DNA, 661 bp, Homo sapiens
  PTBP2
  misc_feature [331]..[331]: Chromosome 1, SNP identification no. = rs2391782
  misc_feature [331]..[331]: allele = g, in linkage disequilibrium with rs10493889, respectively
  misc_feature [331]..[331]: n is a, t, c or g
acactttatgtttaccttgtttttaagaaagattttacatttagacaatttcaggttcgatgtgtgtgtgtgtgtgtgtgtgtgtgtgtgtgtgtgtgtgtgtagtttagggtgtagatccggggacgatgtacctgagtggatcagtaagggttagagtataaagagtaatgtcgttctgtgttgatgacctttaagtctcaagagtctctattagatgacgaagtttgttgaaaacctaaacaaaacgttgaatcaaataattgtatcctgcaaaggtagtgtggtcttttacggtggtataagggaaagacaattagaggttgtaagnccaaagatttgttttttaattactagacgagaatttgaaagttctttaccttagtgtgatacatgagaaagtccagacagaccaaagaaaacgaagtatgttacgaatgataagtgggtacaaaagcgtacatgatgattggtaagaaaacaataatcattcatcattatatgatatactaatatggtgttaaataggtaaaaggacaactatttgtaaacccaataaagttcaaaccctggtaatagtcatttcaaaaactatgtgtatgttcaaaatgtcgtttgtacaagaatgacccattttttgattttcatcttcaatacctgg

SEQ ID NO: 123 - DNA, 661 bp, Homo sapiens
  PTBP2
  misc_feature [331]..[331]: Chromosome 1, SNP identification no. = rs17115733
  misc_feature [331]..[331]: allele = a, in linkage disequilibrium with rs10493889, respectively
  misc_feature [331]..[331]: n is a, t, c or g
taccagtgctgtattgaagtggatgaatctgtgttgaattattttctaggttagtttttaggtaggtagattagtccataaaaaaattcgtatattaagagaaaaggttttatattcccagaggtgagaatatttgaattaaaagctttatatacttaagcaactgtagaggtttactttttccataacacgacatgtttattcttctaatgaaaagttaacagtatgttcacctgttctctagtttgtttccagcttatatccagctgaactagaaatggtgattatataggagcagaaaaagtacaagataatcatagcggtaacatantcctttataattcatgatgtattttcacatatgttgtctttaatttactcctcttaataacccttgaagaagcatgacagccattgtcatcattcctgttttcccgattaagaaattgagattcagagaggtcaaataacttgcttaagatgaccgaaaagagtctaggcttttaattaatcctagacctggcactcgtcagtttcagaacttttcgggaatgacattggatttgctaatttcatcaagataatctgattgggggtgaacatttcaggttaaggaaaatactagtttttttcttttttgcctcattttatgggaattgct

SEQ ID NO: 124 - DNA, 661 bp, Homo sapiens
  misc_feature [331]..[331]: Chromosome 1, SNP identification no. = rs12024594
  misc_feature [331]..[331]: allele = g, in linkage disequilibrium with rs10493889, respectively
  misc_feature [331]..[331]: n is a, t, c or g
gtaattctaacagcaattctttagagcctgcactcatctgccgcacttcgctctttctaacccttgagtcagccaagtgcactcagatcactgcccacaatgtccgttcctcaaatcatttctcatcttccacctcacactcacccatatacttttctgtgcttttttttttttctgaaccaacttcaccactgctactatctccttgacctttttagtgggcctgtggaacgctgttcctcatgccatggtaaacaaaacgtatccttaatgttcataaaatgtgtcttccttgatcttgtcttaaccaatactaacctagttctgcccnttttgtgtgcatcccagaggatcagaaagtagtgcatgttcttttctctcaatggctgcttctcgtcatattctactttcaagtaaaaattcttgcttcaatgaaacatttacatctgaccatgctctcttctacccattttcatctttacaacccagcaacctcctgttcactccacattcattgaaaacttttgcacctagccttttgtccattatcatccaagtccttatgtcctgattattctgatttcctgtttatcacttaaacatatttttatggaatatgttttccttagagttccttgttcacctaaactccagggaccca

SEQ ID NO: 125 - DNA, 661 bp, Homo sapiens
  misc_feature [331]..[331]: Chromosome 1, SNP identification no. = rs11165746
  misc_feature [331]..[331]: allele = t, in linkage disequilibrium with rs10493889, respectively
  misc_feature [331]..[331]: n is a, t, c or g
ataagaagaatcatagaaagaaaacatcgtagtgataaggggtcttggaaatggttcatttctaacccttcatttcctaggcaaagtgtattttcagcattttagaatcgtatcaaatgagagtgaacctctaggtgaaaaatgggccagggaacttgaatttcttttgagccctaagttttcatgttttaataaaaatagatataaaagtactttcgttgaaataaaagccctccataaattctagagattttagttatcttagctgttggttagatgccatagagtgagacagtaacaataaaaccagatctacactggctgaaaaaangttgtctttgtctatggagccttccaagggaggtaaaagcagctttggcctgctgactggtcaacggggagcacttgaaaagagcttagaatttccaaatcgacacaaaagcagtataggtgtcacttcaatctcatataaccttaaaaaaaaacccttgttctctttttgattctgaatgaatatggcctaaaaagaggccatgggaaagcaggatgatatttgcatactcaccatgaagactgtacttgtaatatattcttaatattgaagtctttgtttttagaaaggtgaaatacacctctccctcccctaatacattccaagctg

SEQ ID NO: 126 - DNA, 661 bp, Homo sapiens
  misc_feature [331]..[331]: Chromosome 1, SNP identification no. = rs10493889
  misc_feature [331]..[331]: allele = c, t
  misc_feature [331]..[331]: n is a, t, c or g
tatgtgtcttgcttaaaatagctagttcaatacagactggggaaacaggtgcacttatcttttgtataaaatgcatgcagggttatgatctcatcacacatacaaagaaccctttacaactggaatcatgaacaagaaatgtatttccttcaacttaattatttagtttcctactaagaagttgctctgcagaggtcaattatccttcagggatatcctggaagaaatgaacaattagcttgattttctgttgaatttggagcttgaaactcagtatgtgatctattaaaaaaaggagataattcctcttaaaccatgtcctaatctacantggagtcttacactgcaggtaagaaatcagcaaagtaatccaatccaccaccatggggccaagactgagtatcttgatatacaacaatcatggcttcaaaacgttaatggaaaaatctctcatggggagctatgaagaataacagaattcactcctcttatgaagtgcaaagccttatgaaagggaaatgccatttgattttttttaactaaacagaattgctcaaatctgattaaagagagtagcagcaaacattgtaatttggggtaatcaggagagtgtacagttttatggagagatgaaaggcatgagtatggctttcataagctt

SEQ ID NO: 127 - DNA, 661 bp, Homo sapiens
  DPYD
  misc_feature [331]..[331]: Chromosome 1, SNP identification no. = rs11165879
  misc_feature [331]..[331]: allele = g, in linkage disequilibrium with rs945881, respectively
  misc_feature [331]..[331]: n is a, t, c or g
ccatttagcaaatacttactctttgtggatctgtctgtcacatctactctgcaactgtaacatgaaatctgccatagacaatataaaccaatgggtatggctatgttccagtaaggctttattttcaaaactaggctggtggccaaatttggcctgtgcaccttggtttgctgacccctgctctagcctcagagatgtgaaagacttgacttttggcctaatcctccttggcctaatcctccttgcaacaataactcaaaaagttaatacctgatccaagataaatcagagtcctgctgaggttacactctactcactggatacctatacnttgttgagtttgattattaagtaatctataactaaggagatacagttacatcagaaaattaaagctagattcctaaccctgaggggagtcatgggctagcaaggtaacaaagagtaaatagatcccagagccgatggtttccctaaactgacagactacatcaatcagtccctttcctagtgaccatggaagtctatggtgcagaatcatctggggacactgaaagtggtgccagagccacatcactttcactttattaatactgtacctgctgtaacagattcatctcagatcctttttaaagacaaataaacttgatgctacatttct

SEQ ID NO: 128 - DNA, 661 bp, Homo sapiens
  DPYD
  misc_feature [331]..[331]: Chromosome 1, SNP identification no. = rs945881
  misc_feature [331]..[331]: allele = a, g
  misc_feature [331]..[331]: n is a, t, c or g
aggaacagccggttggtagagcaaccagaagacacacaacacgtattggttaagtttgctgtcttatatgggcatggtttgtggtgctccaaagcaattacaataacatcaaagatcattggtgtaacagatgaccctaacagacataatagtactaaaaaagtttgaaacattgcaagaattatcaaaatgtggcacagagacagaaagtgagcacatgctattaaaaagaatgacatcaacagacttgctcgaagaaaggttgccacaaaccttcaatttgtaaaagaagaaaaaatacatgtgaagtgcaacaaagcaaagcacaatnaaacaaggtatgtttgtgaggtatgtttggaataaggtattagtcatataaattatggtgaaaccaaattcaacagttacttttcattgcctatccaacatccattcctatatttgttcttactaatgggatcctgatattatttagggggcaatgtgtccaatttaaaacttgctttaaattcccttgcagctgggagagaccatttgacttacatctggctagtgagaaataatctgagaatttctgggaaactttttttccctaatatagaacttgtatcttcctgcttttcttctatttctttctgcctgaaaaatatatttctca

SEQ ID NO: 129 - DNA, 661 bp, Homo sapiens
  DPYD
  misc_feature [331]..[331]: Chromosome 1, SNP identification no. = rs11165881
  misc_feature [331]..[331]: allele = t, in linkage disequilibrium with rs945881, respectively
  misc_feature [331]..[331]: n is a, t, c or g
agattacttttactaaagtagatgcattatcttctcctatgggagtggagaagaaaggtctattacattaaaagttataacaaagtatattatatgtcaacttgacaacaattgaacaagcgtagtgctggtattgaaagaggagtctaaggggtatatataacaaatcctagatataaagacttactgtcaatcagtgaactatacagttatttaatatgtggatgtatccagttcttcccattgcattaaactgtcttattcctcctttaaagtggtgttatccatctgaacacatattcaattacattttccactaaggatgaactgntaaaatcaatgtcacatcataaacacctgtatttttctttttccactagagtttaagattgctacaattctataagtattgactgacatcattagattattaagaatgaagaacttgaaggaaagataccgtttccatgtgagtgctaacacagaaaatgtatacttaaattctaccttttttcttcaagtaagggctgaatcagattcaggtacacatggctaaagaacttgtttggataaaatgatacatccaggccagtttcattagtgataataaggaagcacttttattattatattgggaatcaaagacagcaaatttagtttt

SEQ ID NO: 130 - DNA, 661 bp, Homo sapiens
  misc_feature [331]..[331]: Chromosome 1, SNP identification no. = rs11184922
  misc_feature [331]..[331]: allele = c, in linkage disequilibrium with rs2049064, respectively
  misc_feature [331]..[331]: n is a, t, c or g
ctagcacaacagggcaactatagtaaaaaataatttaattgtacatttttttcaaatcacgaaatgtgtaaaactggattgtttgtaacataaaaaataaatgtctgagctgatggataccccaaatgtttgatgtgattattatagattgcaagcctgaataaaaatatctcatgtaaccaagaaatacatacacctattatgtactcacaaaaattaaaataaagaatttttataaaagagtgatatgaactaagttttaattttgaaagctcactctggctacaagatgaaagatggataggctgataaagtggggaagaagggacanactgaaggtaaaaggttgttagtttggtatttcactatttcatgctaattaaaacaaaagcctgcttgaactcaatattagttggtgtcatgcaaaataggaaatagatttcagaacaattcaggaggaaagatcaaatggatttggcaattaattgtatgtgatggttgagggataggattcaatgggaaatgaaaaactggaaggctaggtgtacagtgatgctttttacaaagctatgagatgagaaataagaaaatatggaagaaaaaattttgagttttctcaaaaagagcccgttaaatagtaatatttctggaatatatgact

SEQ ID NO: 131 - DNA, 661 bp, Homo sapiens
  misc_feature [331]..[331]: Chromosome 1, SNP identification no. = rs7530540
  misc_feature [331]..[331]: allele = t, in linkage disequilibrium with rs2049064, respectively
  misc_feature [331]..[331]: n is a, t, c or g
accctctatttaaaatcccactttctctctttcttgccaatctccatccatgcacatttagttgcatttgtcttattagatgaatgtttaatgcaattgttggaggcatactggaagaagaaacgctatgaactgtactacaaatccatcttacaagagaaaaagcctatagatactcagtgaatgcctgcagtgataagacactaggatggcatacactacatggatgaaaatttacctgaaacttaaaaattggttgggatttaaatagacagacatatgaggtaaggggtttgcaagtggagagaatagtttgagcaaatgcacacangcaggaaaattaaacaactgggactaatcccaattcataataagctaaagaataaaagtcaagaatcaattaccagggggttatttttactgaaatatgtaatgtcattcagagctgatatttacaatggtagaatgctgttagcaaaggaatttggttaaacaatcattaggccaaattccctttaattttcaaaataacagttttaacaatggtttaggaaattatttttaaaataatacctccatttaataaatagtctttgaatcattgtaaaacctaacaatgtgtcatctgttcaaattaaattaaaatgtatttattgaacaa

SEQ ID NO: 132 - DNA, 661 bp, Homo sapiens
  misc_feature [331]..[331]: Chromosome 1, SNP identification no. = rs4914979
  misc_feature [331]..[331]: allele = g, in linkage disequilibrium with rs2049064, respectively
  misc_feature [331]..[331]: n is a, t, c or g
tgattgttggaaagtgtgtagaacctccctctttgttctctcttcctcctgctctggccacatgcagacttgcccatttcctctttaccgtccaccatgattgtaagtttcctgaggcctccccagccagattcctgcacagcctggagacttgtgaaccaattaaacttcttttctttataaattaccctgtttcaagtagtcctttatagcaatgtgagaatggactaatacaggcttactgtgtgtatcttttctatgatttgtaagaatacttatataataaatttaatttttctaaatctcaaatttctgaaaacaaaacttattnctttcattgttttttacctgtagtaattattaatcagacagcacaagatgaactaaactcacagactctacataacaatgtgtagtgctataggtgtttagaaaaagcatttatgtaattcatgacatatttttattattaagatgcttcttttgaaatctcaatctgtatttgtgatattcatatcaagtccttttgaaaatcagcatatccttatatctattatgttacatatctagtatatataatatcatatagatacaatgctaagcacttaaaaaacatttgttgagatgctaatatgtggtcaggcactgtactaggtgctgg

SEQ ID NO: 133 - DNA, 661 bp, Homo sapiens
  misc_feature [331]..[331]: Chromosome 1, SNP identification no. = rs4409683
  misc_feature [331]..[331]: allele = c, in linkage disequilibrium with rs2049064, respectively
  misc_feature [331]..[331]: n is a, t, c or g
gatacatgccaagataaaaaggttgtccatatattttaaaatatccagggaaccccaactttgggcatgaaaagaatacttagattaatcagagaagtcctcatctggtttgagaatatcacctgaattactgatgagggatatttaaaacatcattcaaacaaatatattttcatgcattaatctctacaaaataactaaaatcatttataatactttgaataaaaagttatcttttggtatgcacatataaaagtggaaaaattataaatttataactttagaacacaaaatagaccttagaaatattttccttttatctaatttctcnttactgataggattctatgaaaatgctttttatattaagctctcaaaagaatattaagaaaaaacatgacacccctgactatgggtttatattgattaaataaaaagttagagctatataacataaggattataatcatataggcattagaaaacatgtctgtctacttcttttatcagatttttataagggaacataactttgtaatttttttaatgttgatatattccaacacaaaagtccagaaaaagcacagaaaatttatataaaaacatttggtttgggcttatattttgtatatactaggaagaggctgatcttgatcagtgg

SEQ ID NO: 134 - DNA, 661 bp, Homo sapiens
  misc_feature [331]..[331]: Chromosome 1, SNP identification no. = rs10430081
  misc_feature [331]..[331]: allele = g, in linkage disequilibrium with rs2049064, respectively
  misc_feature [331]..[331]: n is a, t, c or g
agaaaaagaaagggaaaaaaagagaaaacagaggctcttagcaaagtaagagtgtgtgtttcctgccagtgggcttcctacctcacgattaaatttcaggtttcacccaggaagaggaagggccaggcttctcccctattcaaatagagcaaacttctatggctccaccccagtgtgcaggctggttggagtttctctggggaccccgaaccacctggctgccctattttggcctatagaaactacattcttctagatttaaggcatttctctagtatacagtttgctctatcagataaatttgtgttgtatagataagaaatgaaagggnaaaataaagcagagaggatacaaagttccatgggtttcaattttagatcaaatagacatggaaggtttcattgaaaagataacattaaagaaaaggccttaaagaaatgaggaagataccatcaaatgtgaggaacagaatcttccaggctgaaggaaaattaaaacacaaagacactgcaggataagtatgcctaatgtgtacaaagaagagcaaggaagacagtatggtaagaaatggtgaggaagtagggaaagaagagatcagaaaagctagggagcccaggttgtttagggcagtactgcccagtagaaataggatataggtcac

SEQ ID NO: 135 - DNA, 661 bp, Homo sapiens
  misc_feature [331]..[331]: Chromosome 1, SNP identification no. = rs7527883
  misc_feature [331]..[331]: allele = t, in linkage disequilibrium with rs2049064, respectively
  misc_feature [331]..[331]: n is a, t, c or g
gtctgcactctaatttatttttaatagctttctgcattttggtgatgttgtttaattaagtcaaattgtttctttttaaaaacaactgccacatttactggctattccattattggctcaaatttgtacctatcctttgggatattagtgttatttaacttctgaatgctcattattgatcctataaatttattgagatgtctttggacatctgaagatataacctgcatagtactttctttatgtgtttctatgggactagtggaatgatcaatttggataaaataggaaaatatactgtgaactacatgctagaaaatgcaaagaaaanaattgtcattgtgctcaacatgtgaaatattctacgatgctagattatatctgccagtgcttcaggaaatggtatttggataaattaattagtacttcgttgatatgttatttatcgtatattggctataaaaattatagttcaaattattaatcttttagtagtggcttacgtttgtacattatacttggaatatgctagtataaaatgagagaggacataaattactatactagaaacataaaagtttaagaagtggcatctctacagattccatgaatattaaaaagtggaatagaagactccactgatcatcctgcacaacctccc

SEQ ID NO: 136 - DNA, 661 bp, Homo sapiens
  misc_feature [331]..[331]: Chromosome 1, SNP identification no. = rs12066688
  misc_feature [331]..[331]: allele = g, in linkage disequilibrium with rs2049064, respectively
  misc_feature [331]..[331]: n is a, t, c or g
tctgatgcactgtattgaatgttttcaattatgattttatttttctatcttaaaatgactttagtcttttctgagctcattgttaaaatgaagtttcagttcactaagcactggtatgaactgttttaccaaagattctagatattcacaaaaatagttattcagaaattaatatcacctttaaggtttttatgacttctcctttattgttgatgcttcagaatattttggttttttaattcttttaaactaggaacattttttaaaactaataatatctactaattagttttcttacttctggggaattggaaaagagataaacttaaantcctcaatatttgagattgggaaatagatcagctttaaaggttccttttatttgctttcaaaatgcaaatatttgcagaatacattcttgtatttttaattaaatcaattcttgatttaatgtttgcaataatatattccaaaaagaggagattaataaacagaaatgcatattatttgcctatccaaagctatgtattcaaatgcacatagcagtattctcttataactttaaacttgtaaacaaacaagaaagaacaaatttatatcaacagtagaatgaatgttacagtatgtacataaaatgtgatattaaatagcattactaatg

SEQ ID NO: 137 - DNA, 661 bp, Homo sapiens
  misc_feature [331]..[331]: Chromosome 1, SNP identification no. = rs7545951
  misc_feature [331]..[331]: allele = a, in linkage disequilibrium with rs2049064, respectively
  misc_feature [331]..[331]: n is a, t, c or g
attattatatctgtgcacagctttacaattttaacaatatcgcaactttaatttttagattttcaagtaaagactctgctgaattgccagtgttctacagaccagaacaaaacctgacttagtagaatggattacacaagtaagtcatgtaaggcagcatgaagaccacccagctttactttgtgaggtgtaattctcactgtagacttccatgtcattcaaagcagagcatttagggcagaaaacctcaggatattgtgcaatatccttttaggactggcccattcccaagctgtactgtaatcagtggattaaaaaaaaaaaaagcacntaagcataaattgggagagtgtaagagataaagtcagatttcttcagttttaagtgggggggacctatcttatatctacccccagtaccaagaacaatgccaagagggcacgtgcttcttatatacagtataggaagcaatgcacatagccttgttcattgcacacttgctgtgcgaccataggcaagtcattttccgtctccaactttagtatgtcccttacaaagggtggttggtaatgaaacctctctctgggattgtttcaaaatgtgattagattacgcctgtgaaagcactctgtgaaccctaaagtgctctgcaaatataagg

SEQ ID NO: 138 - DNA, 661 bp, Homo sapiens
  misc_feature [331]..[331]: Chromosome 1, SNP identification no. = rs4311915
  misc_feature [331]..[331]: allele = c, in linkage disequilibrium with rs2049064, respectively
  misc_feature [331]..[331]: n is a, t, c or g
gagtaactggcaaagttgcgtatcttataacctccagagtaatagctgacattcttttatgtctgtgcattagcaggacgcaggctcctcccctctccccagcctgatgatctccattagctttacaaaagtgactgacttttagaggaggcctattatcatttagactatagcctaaatgtcttcccaagttagcttggcccaatagccaaggattaattaagggaaatccaaggtgatgagttaactcagatctctttcactggtataatttttgcaaaggcacgttcattttcaccactatcctttttatcatctgtgggctttttantgatattaggataacaaaaacaattataatcaaacagctgcagcataatgattaatattgaaataatgacaacagcaacagtgacagtaaagtgactgtagcaaggtgcttaagcctgcaggctgcaggctgtcaatcacacgtctatttatattctagccccagtgctccttattgttttttttttggttttgagatgaaatcttgctcggtctctcaggttgcagtgcagtggcacgatcttggctcactgcaacctccacccctgggactcaggcgattctcccacctcagcctatcaagtagctgggactacaggcacgcaccaac

SEQ ID NO: 139 - DNA, 661 bp, Homo sapiens
  misc_feature [331]..[331]: Chromosome 1, SNP identification no. = rs17017475
  misc_feature [331]..[331]: allele = a, in linkage disequilibrium with rs2049064, respectively
  misc_feature [331]..[331]: n is a, t, c or g
ccagttttttgttgaaaaaaaataaagattaagcaaaaagttaaacagattaaccaaaagttcttatgcttatatctaggcagaaataatgatggttagtaaatttgactattaaaaatctaaaacaagactgcaaaagcagctcccccaattaaaaaagagaaagaaatttatagaaaacaaagaaactgaaggaataaaaaatgcataacatgtacaataaagtataaattttatacatatataatatttaaaaatacaaaagataaaaaagggagaagtttaaattgtttgcctaaaattatatagctaagaaagcagtatgacaagnttggaattttactgtttgctgagaaaacatgtactgcagggctcacagtacatgtgacaaatggcaaagtgttggccataggggcaagacaggaccaaggactaaacagaaatttataaaaatgattaaaatgtctttaatatgtgcttatcctttatttgatccaataatctcatatttagaaatttactccaaggaaataatcagataactattcaaaacggtcttttaaaaaaccacagttgtgaaaacataaacaccacttaagtatccaacaaaaatgtattgattaaaataattataatgtatagccagattagagatacagat

SEQ ID NO: 140 - DNA, 661 bp, Homo sapiens
  misc_feature [331]..[331]: Chromosome 1, SNP identification no. = rs17017532
  misc_feature [331]..[331]: allele = t, in linkage disequilibrium with rs2049064, respectively
  misc_feature [331]..[331]: n is a, t, c or g
cacaaccttggtttgaccttaaaattcttccttctggctgggtacggtggcttacacctgtaatcccagcattttgggatgctgaggcaggaggatcacttgagcccgggagtttgaaacaagcctgggcaacatggtaagactccatttctacaaaaaaatttaaaaattagccaggcctggtggtatgtgcctctagtcccagctacttgggaggctgaggtgggagaattgcttgagcctagggagttgaggttacagtaagacatgttcatgccactatactccatgtctcaaaaaaataaaataaaataaaatccctccttctatntatggtgcagctagaaataccccataaagagacaccagattctgagttctagtgtattatgatatttccccagacactgacttatattcatcttccagaattcctatcctgcattccggtgtgcccctcacttggtaaagcactacatcaaagctgccttttgcttatctgaggattccttggactgacactttactatgactgcatgtttgattttccaatacagttctgacatataacaagggcttttagattcattagtaacactctagaaagatcctcataccagaaggacccatcagctctagaatgacagcctgaacaaaccac

SEQ ID NO: 141 - DNA, 661 bp, Homo sapiens
  misc_feature [331]..[331]: Chromosome 1, SNP identification no. = rs17017567
  misc_feature [331]..[331]: allele = g, in linkage disequilibrium with rs2049064, respectively
  misc_feature [331]..[331]: n is a, t, c or g
ccttttccagcatcaggcatggcttagttttgtaattttaggtttaaattaaaacaaaatattgttcttaggattacatgtatgaagaaaggaagctttagcttctcacaggggaattatctatatatttttggagtcctgtttaaatctatcatcaagatcctttcttttataactacctaatgatctattattcaagccaaaatattgtaggttttatggttttcacttattattcagagcaactgtctcatgactatgtaacatctcatatcccactcagtgtctccagcctaagaaaagttggatatgtttttctctcttatttganttgtgagattcaaataaatgtgaatcagataaaaacttaacccttttacaagattagctattatggcctgctgaccggctgattaaaaacagaaactatttaatgagaaattaagttttaaatggaaagcagagccatacacagcagcctcatcaggagtaaatacaggttgtaggcacaaatataagacataatactttctgctcccatggggctcttctttgacaggcagagccaccaaaaaaaggaaagtaaaattctcattatcatcccaaggacacaaaacggtaactgaattgagtaggagaaaataattgggttagaatttat

SEQ ID NO: 142 - DNA, 661 bp, Homo sapiens
  misc_feature [331]..[331]: Chromosome 1, SNP identification no. = rs12085613
  misc_feature [331]..[331]: allele = t, in linkage disequilibrium with rs2049064, respectively
  misc_feature [331]..[331]: n is a, t, c or g
caggagttatgctacatcagatggaagaagcaatgcagtgtctggtaaggaaaacaaacaaacaaaacatgagttgtccaggactagctctactagaagcagtgtaacatgttggaaatagctcttcaatcagaaagtctggtctccttatatactagctatgtagctttagacaatccatttaagtccctgaaacttctcccatattttaataaaaatatcttttgagataacatccacaagcacttttaaaacacatatatgtaattagtaaggactgggggacaggagtatgctgtaaaatgctctgcaaatataatttcatgaaaanacataactacactggtgatattaaatggactttaatcagtggtgataaaagatggtcaattgtctatataatggataacatggtagccatttttcaacttcaagtttaagcttcaatgaaccctcatttcctcaagcccataatatggccagtaattaaaattatatttctggttttagttgaaacttctatgattcaagtggttttgcagcccttctcacatcaaaatatacagagagccatttggctattttcataatactgagttggttggtttaatatcaaggttatttttgttttgttttgtttagctatataggtctactggtt

SEQ ID NO: 143 - DNA, 661 bp, Homo sapiens
  misc_feature [331]..[331]: Chromosome 1, SNP identification no. = rs12078403
  misc_feature [331]..[331]: allele = c, in linkage disequilibrium with rs2049064, respectively
  misc_feature [331]..[331]: n is a, t, c or g
cctataaggtttctgaaaatgtgataccagcagaacactgtcagcctggacaaaagaaacagagaccagatgaaatgatggaaggttatcagacttccaaaattctgcaggcacaaaacatgctgatagagctacctgactgcaaacatctgctcttgttcaagaaaaaggaagaatgattcagagggcaatggagctgccagcaagggcatggagggtgaggaagctgccacttagagtgcaggaggcagaacggtgaggcaaatcattattctcaggccttccaatctaacagaatttgccctcctgtatttcacacttgtttagaacnagtgacccctttattccttccatttcctgtcttttggaatgggaatatctatctcatgcctacatcatcattgtattttgtaagcaggtaacttgttttcaagttttacaggctcacagatgaagaggaattttatgtttggatggatcatccctatagtctcaccgatatctgatgtagattatttcagtgatgagatttgggactttttgtgtttataatattctgatgcgatttggaacttatagttaatgctatagtggactgagacttttgaatatattgagacgaagtgaatgtattttgcatgtggaatggttataaagtttc

SEQ ID NO: 144 - DNA, 661 bp, Homo sapiens
  misc_feature [331]..[331]: Chromosome 1, SNP identification no. = rs12409858
  misc_feature [331]..[331]: allele = t, in linkage disequilibrium with rs2049064, respectively
  misc_feature [331]..[331]: n is a, t, c or g
taacagaatttgccctcctgtatttcacacttgtttagaactagtgacccctttattccttccatttcctgtcttttggaatgggaatatctatctcatgcctacatcatcattgtattttgtaagcaggtaacttgttttcaagttttacaggctcacagatgaagaggaattttatgtttggatggatcatccctatagtctcaccgatatctgatgtagattatttcagtgatgagatttgggactttttgtgtttataatattctgatgcgatttggaacttatagttaatgctatagtggactgagacttttgaatatattgagangaagtgaatgtattttgcatgtggaatggttataaagtttctggtgccagaggacagagagcgtaggtcaaactgtgtccttacaaaagatacgttcacttggaagttcagcatatttgcttatttggtataagggtattttgcagataaactaggtgaggattttgagatgagataatcctaaattagagtgagccctcaatataatgataaatatcctaatacaagacagaagaggaaaaaacacagacacacacagggaagaaggccacaggaagactaaggcaggaatttaaatgatgcctataagagccaaggaatgccgaagat

SEQ ID NO: 145 - DNA, 661 bp, Homo sapiens
  misc_feature [331]..[331]: Chromosome 1, SNP identification no. = rs11184981
  misc_feature [331]..[331]: allele = a, in linkage disequilibrium with rs2049064, respectively
  misc_feature [331]..[331]: n is a, t, c or g
ttgtttagaactagtgacccctttattccttccatttcctgtcttttggaatgggaatatctatctcatgcctacatcatcattgtattttgtaagcaggtaacttgttttcaagttttacaggctcacagatgaagaggaattttatgtttggatggatcatccctatagtctcaccgatatctgatgtagattatttcagtgatgagatttgggactttttgtgtttataatattctgatgcgatttggaacttatagttaatgctatagtggactgagacttttgaatatattgagacgaagtgaatgtattttgcatgtggaatggntataaagtttctggtgccagaggacagagagcgtaggtcaaactgtgtccttacaaaagatacgttcacttggaagttcagcatatttgcttatttggtataagggtattttgcagataaactaggtgaggattttgagatgagataatcctaaattagagtgagccctcaatataatgataaatatcctaatacaagacagaagaggaaaaaacacagacacacacagggaagaaggccacaggaagactaaggcaggaatttaaatgatgcctataagagccaaggaatgccgaagattgcctgcaagcaccagatgctgggagttaa

SEQ ID NO: 146 - DNA, 661 bp, Homo sapiens
  misc_feature [331]..[331]: Chromosome 1, SNP identification no. = rs12407314
  misc_feature [331]..[331]: allele = t, in linkage disequilibrium with rs2049064, respectively
  misc_feature [331]..[331]: n is a, t, c or g
ttgttttcaagttttacaggctcacagatgaagaggaattttatgtttggatggatcatccctatagtctcaccgatatctgatgtagattatttcagtgatgagatttgggactttttgtgtttataatattctgatgcgatttggaacttatagttaatgctatagtggactgagacttttgaatatattgagacgaagtgaatgtattttgcatgtggaatggttataaagtttctggtgccagaggacagagagcgtaggtcaaactgtgtccttacaaaagatacgttcacttggaagttcagcatatttgcttatttggtataanggtattttgcagataaactaggtgaggattttgagatgagataatcctaaattagagtgagccctcaatataatgataaatatcctaatacaagacagaagaggaaaaaacacagacacacacagggaagaaggccacaggaagactaaggcaggaatttaaatgatgcctataagagccaaggaatgccgaagattgcctgcaagcaccagatgctgggagttaaggggtggaatgcaatctccctcagagagaacccctagaaggatacagccctgctgataccttgactttggatatatctgtcttccagattagaaaaaaaaaaaa

SEQ ID NO: 147 - DNA, 661 bp, Homo sapiens
  misc_feature [331]..[331]: Chromosome 1, SNP identification no. = rs12406199
  misc_feature [331]..[331]: allele = c, in linkage disequilibrium with rs2049064, respectively
  misc_feature [331]..[331]: n is a, t, c or g
ggaacttatagttaatgctatagtggactgagacttttgaatatattgagacgaagtgaatgtattttgcatgtggaatggttataaagtttctggtgccagaggacagagagcgtaggtcaaactgtgtccttacaaaagatacgttcacttggaagttcagcatatttgcttatttggtataagggtattttgcagataaactaggtgaggattttgagatgagataatcctaaattagagtgagccctcaatataatgataaatatcctaatacaagacagaagaggaaaaaacacagacacacacagggaagaaggccacaggaagnctaaggcaggaatttaaatgatgcctataagagccaaggaatgccgaagattgcctgcaagcaccagatgctgggagttaaggggtggaatgcaatctccctcagagagaacccctagaaggatacagccctgctgataccttgactttggatatatctgtcttccagattagaaaaaaaaaaaatctacttctaacattttgagccactaagtttgtgatcatttgttatggcagttttagaaaactaatataaaagtcttgagttatctgagtcagtgaaagaaaaaaagaagaaaagaaaaaagtgagcaaggctggatcatataaa

SEQ ID NO: 148 - DNA, 661 bp, Homo sapiens
  misc_feature [331]..[331]: Chromosome 1, SNP identification no. = rs12407335
  misc_feature [331]..[331]: allele = a, in linkage disequilibrium with rs2049064, respectively
  misc_feature [331]..[331]: n is a, t, c or g
tggaatggttataaagtttctggtgccagaggacagagagcgtaggtcaaactgtgtccttacaaaagatacgttcacttggaagttcagcatatttgcttatttggtataagggtattttgcagataaactaggtgaggattttgagatgagataatcctaaattagagtgagccctcaatataatgataaatatcctaatacaagacagaagaggaaaaaacacagacacacacagggaagaaggccacaggaagactaaggcaggaatttaaatgatgcctataagagccaaggaatgccgaagattgcctgcaagcaccagatgctnggagttaaggggtggaatgcaatctccctcagagagaacccctagaaggatacagccctgctgataccttgactttggatatatctgtcttccagattagaaaaaaaaaaaatctacttctaacattttgagccactaagtttgtgatcatttgttatggcagttttagaaaactaatataaaagtcttgagttatctgagtcagtgaaagaaaaaaagaagaaaagaaaaaagtgagcaaggctggatcatataaaaataggggtaactggacatgagtgtaaagaattagccaaaggctgacatttcccaatccctaagggccactaa

SEQ ID NO: 149 - DNA, 661 bp, Homo sapiens
  misc_feature [331]..[331]: Chromosome 1, SNP identification no. = rs12410591
  misc_feature [331]..[331]: allele = g, in linkage disequilibrium with rs2049064, respectively
  misc_feature [331]..[331]: n is a, t, c or g
taaaaccactactatgatttctctgtttgatctcaagtcttttctcaaaccagctccttttcttcctgcagccacacacatgaatgaacaaacacaaacatatctaagaaatatcaatttgtattcctttcatcaggaatcaatagagccacaatctaccagcaactggctcttcctgtaatttgcactgatttaggttatttgtttttattcaattactaacgcttatttttccaactagcttagacatactccaggaaagcattctacatttatgttagaggaagtggagggtttatcccactgtcataatcggcctagattccaggtnttattttcaatccctaaaaaaagactttcttatgattctttataatctagtcaaattctgtcttcccttatgttttgtttgtttgtttgtttttaagagtatcagaaataattggagatgatgctgtttgttttgactcccactctttctactccttaacatgaaagatcagagtctgggctctctactcttcccaaagtgttacatcctctggcccatctttattcctttgctcacattcttactcctgctcaagtgtattcccaccccttcctgcccagccaatccctattcatgtttaatggctgaagcactttccaaaatcttccc

SEQ ID NO: 150 - DNA, 661 bp, Homo sapiens
  misc_feature [331]..[331]: Chromosome 1, SNP identification no. = rs10494050
  misc_feature [331]..[331]: allele = c, in linkage disequilibrium with rs2049064, respectively
  misc_feature [331]..[331]: n is a, t, c or g
ggcacacagcagtaaaataacttgcccaaggtcatagactaagtacatagcagagctgagaatcaaacccaagcaatctggctccatagcctgcaatctgaaccaccataaaaccatcacaatgtactgcctcatcagttctgcatttcagacatattgcatgcttttcccagtttctgatgtcaatacaatcaatagatattcaatatttattacgtgtcagctatcataatatgtactaggactataaccccagaataaaactccatctgtgctttcaagaagcctatattataaggtagaatccagaaaaataaatgaacatataacnaaacatattgataagtattaatatcacaatagggacaagaagaggatattatgggagcacataggaaggaaacttatcatagtcttgggactgaaaagactttccagaggaaatatcatctaagctgaagtctgaaagagctcttgcaaacaagttaaggttgatggactcacagtactgaggtgtctagaggaagatggacatgagagaatgtcatggtcaaaggtaaaggcatatgcaaaaaatgtgaggcaaaagaaagtttggtaaatttcagaaactttaggttgttcattgtcatcatacagaaaagtaaaagaaggtcaatgg

SEQ ID NO: 151 - DNA, 661 bp, Homo sapiens
  misc_feature [331]..[331]: Chromosome 1, SNP identification no. = rs12079669
  misc_feature [331]..[331]: allele = c, in linkage disequilibrium with rs2049064, respectively
  misc_feature [331]..[331]: n is a, t, c or g
atttagagctgataccacagcttcacaactggatcaaatatacaaatggtagactgattgaaagaataaagaaacagagaaaagaatgaagaagtgaaatatttatttacttggtggctgagttagaatcaaagtgctctgctttccagatttctccataatgcactctaatacctgcattcctcaaaactaaatatatgttgaaatttttgaatcatatgacatttaaatatattaaggagatttactatttataggaatattatggcaaattgttttgcaagataaataactagtcgctaatttaactggttcaaaactcagaatttgnatacactttgtttgcttaagcaaattaaatctaagtgaaaaatatgaggttcacaaaccataagacctacttggctcccagaggactttctcagcatataatagtgtgccagattgagtggcacaattttagttcctggcaagatgataaataaacacaagctcctgtgttccctcactcccaccatggcccaaccttgaaagtgctacagacgagaaagggtttagggtaacattttagttttattatttttctgtctgcaaactatcctgtatagattattgttttctcttccctcactcccatcaccagtagaggtagaaaaattat

SEQ ID NO: 152 - DNA, 661 bp, Homo sapiens
  misc_feature [331]..[331]: Chromosome 1, SNP identification no. = rs10494052
  misc_feature [331]..[331]: allele = t, in linkage disequilibrium with rs2049064, respectively
  misc_feature [331]..[331]: n is a, t, c or g
ctctgaatgctttaaaacaaatatatctcttctttgtcttctgttctgctaattaaacatctcaacttcatagttttctttatgagacatagatatcagaagtctcaccatagtgcttacctatttctccagactgttttatgtggaaatcttaaagctgatagatgaaactttgtatcttgttgggaaaaatcacacaaattatttttaaccctagggccacaacagaacccattcttgttgcttattttcctttttaaccatttaaaaaaacatcatgagatatatgatccttatattagagcaaacaagttagaatatggtaggaaanaaaatactatgcttatttagaagtccaaatagaaattccagctctgtcccttgcaggttatatgattccatgagcaagttatttgacagttatgaggcttggttcattcagccttaatatgaggatttgaaagatttacttctataatgacttatggtacaaagaactatgcaaataagctgaaggagttggaaataatgatgaaatgtatttcaagaaagcactacaaaactttgaatcatacgttttgacaaaataaatatttaagtgcaactctaccaaaagtgtgaattatactcatccagttgcagagattatttttgaaaagac

SEQ ID NO: 153 - DNA, 661 bp, Homo sapiens
  misc_feature [331]..[331]: Chromosome 1, SNP identification no. = rs17017658
  misc_feature [331]..[331]: allele = g, in linkage disequilibrium with rs2049064, respectively
  misc_feature [331]..[331]: n is a, t, c or g
atacaacgtagagtggaaagctgagataagtgcaggtaacattcttaaacatttacctcccatcctattattcattttttaacacttgataaaatagggtacaagtatttataatagtatttacatctcccagaacatagaaggtgataactattattataatctcaaaacaataagcaaaaataggattggtatgaaagagataattctaaaagagtaacgtctagtatcatcatgtggctactgctaatgaaggtgaaagccaaaaggcgtcacaacattcatcaggagtgtgtctgcatgtcacacatttctaagcattcttccaganaatttctggttcttgagcactccttattttaaattgaaataatacctgacctagtttgaagtacagaacttgcatataagtaggctaaaggcttcctatcttatcacttacctccttgacgtgaactgagcagatactcttcaagcacagttcattatccccctccaggcattagcccagtcaggtaatgtggtcattatttctcaaggaaaagggatttttttttttagttatttttttcaaaatggcatttgattttaagcatagccttcctaactcttactcatttcctcctcctaggcaagaggccattggtgggacagtcagact

SEQ ID NO: 154 - DNA, 661 bp, Homo sapiens
  misc_feature [331]..[331]: Chromosome 1, SNP identification no. = rs17492154
  misc_feature [331]..[331]: allele = c, in linkage disequilibrium with rs2049064, respectively
  misc_feature [331]..[331]: n is a, t, c or g
gagcagatactcttcaagcacagttcattatccccctccaggcattagcccagtcaggtaatgtggtcattatttctcaaggaaaagggatttttttttttagttatttttttcaaaatggcatttgattttaagcatagccttcctaactcttactcatttcctcctcctaggcaagaggccattggtgggacagtcagactaatgctgaaaagaactttactttttaagaaatttacatctaggaaatattatcagtaaaggtattctataaaaattgacaaaataaatttctgatgagtattatttgctaaataaaattccaagactnactgcatgattaggtttatttattaaaagtttttgtggggtggatttgtaaatactttaaaaaattctaagtgctccagttatataatattaaccatgagagtgctattatatttataaaaccacctctgaacaaaaagacaatcaacttttatagaaatgtgtttatatatgtatagaatgtatatttatgtctatgcatacatccaattctcattttaaggagactaatctttatgtgttttttaaattcacatcatgagctttgattcggtttcagaaactagctaaatgcaatgaattatatccacttacacatttttattggtca

SEQ ID NO: 155 - DNA, 661 bp, Homo sapiens
  misc_feature [331]..[331]: Chromosome 1, SNP identification no. = rs2139462
  misc_feature [331]..[331]: allele = c, in linkage disequilibrium with rs2049064, respectively
  misc_feature [331]..[331]: n is a, t, c or g
actagacctcgaccctctcgagatcaagtgattcctttaccctttttccgtaaaacatcgttacttattccaaattctccttcgtctcatttgaacattatgttcttttattcaaactaaaatacaattccctttatctgttattcccttaactatctaaaactcgtcaattgactacttattttaatacaaatctttatatcttgtctattactctctgttgaacatccttctagacaactttccaattcttcactagtgcaggaataaaaatattcgttgtcacttccatatctttctacctaatcaaactttttataaatcttatatnttagttatcttgaacctctaacttatacatctctttctcccacttcttttattagttcctaatggggtcgttcaaatatataacttactggcgatatactgtaatattgggtaatactcatttataacctctttcttttcagaattccccttttttcccccaagtggcaacgtgtaataccagttgtcttatgaccatggggtttctacacgtacaagactaacggggttttctgagacgtctacgttaatttaattcctggaactctactctctttaatagaacccgttaagtccagtcgggatgtattagtattctttcacctccatc

SEQ ID NO: 156 - DNA, 661 bp, Homo sapiens
  misc_feature [331]..[331]: Chromosome 1, SNP identification no. = rs17017694
  misc_feature [331]..[331]: allele = a, in linkage disequilibrium with rs2049064, respectively
  misc_feature [331]..[331]: n is a, t, c or g
actgtagaacttctaagagactcgctaactttaaatgtgaattttaataatattgattaacattctataagccatttgatgtggagccattctcatgaaataaaattttaaatgttaattatgcatagaggaaatccaattcaattaatgtttgtgaaaatcatagtaggtacaaaacactgtgtaagctacccccaaatgtataaattcccttaagttccctgaaagagctagtaagaaaaatgctacctataaatagcagtgcaatagacaatgaggtgcatgctatgagaaaatccataaaaatatacaactacagaaaagagaaaantattgtaacatgttactgcacttagccacttaataatccagaccagcaagacaattagtctgggaatgaagcccagttttaccattaagaatgtaaagatcaaaacccaggaaaagaaggcattgcgcctgactaacagaggtttatttctgaagacaagcagctagaagtggccatattttcctgattataacatgcagaaagagtcaaccctgcaccttatcctgcatctgagggatagctgtcaattcttcaaccttgttttcacaatgtccagtgatgacattactctgcactacagccattcaccccatttaagtaaagaaatta

SEQ ID NO: 157 - DNA, 661 bp, Homo sapiens
  misc_feature [331]..[331]: Chromosome 1, SNP identification no. = rs17017723
  misc_feature [331]..[331]: allele = c, in linkage disequilibrium with rs2049064, respectively
  misc_feature [331]..[331]: n is a, t, c or g
tgattcagtaggtctaggacggggtccaataatttgcattactaacaagttctcaggcaatgctgataccgctagtttaagatctcactttgagagtcactagtgtaaaggttaagtttaaactcaaattcagcaccacaagctatgtgtcctagggcaatatatttaacctccaacctcagttttcttatttgaaacctaggaataataatagcaacctacatcatagagttgtttttttttttggtgattaaatgagttatacgtttaaaatgtttataaaaatgcctgacacctactcagtactgaaatagtgttattgttgttcttngtacttacacgcataggtcatccagcataatcataaatgaattaacatcaaagaaacaaaaaaaatgtctttctctgaaacatttggctgagtgctggacactgggagaaaaagaatgttgataggcttattctccagagtgacctggaaaggaagattccagggaagaatgtaagtcttgaatatatcatgatggatcatcacaaggcaagaaaagaatgcatgaaagagatagaggaaagggcactaaggtgaaagccttttatttctccttgatatgccaatgctaggctcatattagggattcagtgaatatgttttacatgtcta

SEQ ID NO: 158 - DNA, 661 bp, Homo sapiens
  misc_feature [331]..[331]: Chromosome 1, SNP identification no. = rs17017736
  misc_feature [331]..[331]: allele = a, in linkage disequilibrium with rs2049064, respectively
  misc_feature [331]..[331]: n is a, t, c or g
ttttcctatttatttcttcttaaaaaaatcaagcccaaatttcctattccatagaaggtgacattttcaacatatacctgcatcctgaggtcctttacctcatatgcccagagtccatgagcaattatgtaatcactccatttttccacttccttttctacatcttctttgtcacagggattcacatactatgttggaatcacacactttcttcttttgttcattttcaaacagtaattgtgccaggcttgtgacatgctaggccatatttgttgtctttcctctacatgagctcattgaggtcaaggactgtttctcatttatctcctgnaaccctgttcccagcacatatagaggaggggaggttggtcaagaaagagttcggcaagtaaagctgtagaagtcggagtcagctgaatgtaaaaagtcaactggaaatgggatagatgatgatattatctgatgataaaaacaaactgctaaaaggatgcccattgctgctctgtctttatgacctgtgcaatcaaacccagaataaaagaatgtagtgtattcactagggaatcattaaatacatctatggcaataccaaaaaagaaagcctctagacactgatctttcaaaagggcaaatatgtaaactgatctctgtctctatcatt

SEQ ID NO: 159 - DNA, 661 bp, Homo sapiens
  misc_feature [331]..[331]: Chromosome 1, SNP identification no. = rs12097821
  misc_feature [331]..[331]: allele = t, in linkage disequilibrium with rs2049064, respectively
  misc_feature [331]..[331]: n is a, t, c or g
acaaatacatacacacacacacacacacattcatgtacctcgtgtcagacttcgcatgattttaattctcataaccatcttatgggtaatttactaacatcatccctattttataggtgattcaacaaatccacagaaatgtgcaataacttgttcaaggttacattacatagctcataagtggaaaaactgggattcaaactcaggcagttgtatacttatgcactgagctataataagagtgagatggccagaactcaccattatgtgaaattgacaggtcattgaacaatatttatgctaattgtcttatttttacaaatgtaaagcnacaatgaaagagtgagtagaacaaaatcaagagtgaagaaaggaaatgaggcaatctaaaactctctggcacatccccaactaattacagaaaacattaaattgtgtttggaagatgcaacattctgaaagttcactaaagcacttggctctctctgaaatgccccttcagctggtaagagaagatcatttcatatcccctctactgatccgcttgattgcatgtcagctctattaggcagttgcttctcactaatccaagctgactttttattagccacttagacctcaagcaccagacacatgacaattttaaggtttaaaagctgcc

SEQ ID NO: 160 - DNA, 661 bp, Homo sapiens
  misc_feature [331]..[331]: Chromosome 1, SNP identification no. = rs955988
  misc_feature [331]..[331]: allele = c, in linkage disequilibrium with rs2049064, respectively
  misc_feature [331]..[331]: n is a, t, c or g
ttttatagcagtaatttgcatatcttcctttccagtgagactgaaaactgctgtaaggtagagtttctatcttattcatcactgtttcctccttagaactctgcacatagtaggagctcaccaaatgtttattgaatgaacagatgaataataaatgaaagaacgattaaagcacagcttctagattaaccagcaattgtgactctctgaatttttggttttcaccatttaggtttcagggctataaacttagcaacaattatttaatatccccttgcagatcctgtttctaaccttcactcttcaaaccactttattctaatccacaccnaaaccttttctttgagctctgtgatcccttgatgctcaagaaaaccctgagatatcactttgaaattttttaaaaatagaatacttgcacaaaaggaaataaaagtgctttagctccaagcactttagtaacagaggtgatgagaattcacaggaaaactgacccacaaatgatatacccagctgagttgtgttgatcaagaggaggaaagagacacatctccccttctgaggacaaacacacctagctctttaacatcaaggacaaacaaggtggaggagagcaaaaagcaaaggccaagatggttaagtgactagattaatgacattc

SEQ ID NO: 161 - DNA, 661 bp, Homo sapiens
  misc_feature [331]..[331]: Chromosome 1, SNP identification no. = rs1519889
  misc_feature [331]..[331]: allele = c, in linkage disequilibrium with rs2049064, respectively
  misc_feature [331]..[331]: n is a, t, c or g
aaatggaaaggtttcactcgttacagtgagagagaagaaggatcgtccttatttgaattgttataaagattgtcacggcgacaacgaaaccggattcacaccttgtcggaaactttctaatgttgtcgttttattcagattgtaccgactgacatagaacggaaatcggagtgtccgaccgacaggaacgagtaaggatccgtatccggttcgataggtaccctctttaaatcacatatcaaattgaaacttcgttgttaatatcatcaaggagggattttgcttcggggagaaacgagtctctggttttgacggaaacattctgattacnttccggtgttcgaatcctaataccctattcagacttaagacgattttacatcctcatttgtttgggttggtaacagggaccgaacggaaagatattagggaacgacaaaccctcagtgcaccggtctccaatgttctaaacactgaagggattaacctggatatccattgtagtaataacatctttgattctaaccagaaaactctacaaaaagtctgaaaccgtcagaccgttagttgactgaggaaggtctgggccctgaatactgagtgagtcggtcatgacctcagaggtagatctccatttgagtcacgtgctcctagtaaaagg

SEQ ID NO: 162 - DNA, 661 bp, Homo sapiens
  misc_feature [331]..[331]: Chromosome 1, SNP identification no. = rs1519887
  misc_feature [331]..[331]: allele = c, in linkage disequilibrium with rs2049064, respectively
  misc_feature [331]..[331]: n is a, t, c or g
taattaaacaaagtgacgtctttataacgatacaaacttatatccctagaaaagatctgagattacacccacaatatatattgtaccacgtccctgacataatagaaggatgttagatttaacaaaaattagaagatagattttttaaaaaaaataatagaaggatattagattttgggtcgaccgaggtttccaaaaaaaaatcccttaatgtttagggatagtgaatactatacatcgtatgagaccattgattccgattataaacgaaggggcgaatgatatcacccctttacacaaggactctaactcactagtagatcggtaatgngaaagatcgagtagaacggcgtcaacactaggatactgatttatattggttatcttatatttttaccatataagtattaaaatagagtaaataacagtattattgaagcccttcagtgataccaatcgtcataataaaaactttagtctttatatctccgaatcttcaagaacttcgagtatttactcttggaatctccaccttttattaagaagactacagtttagggtacgaggaggatggtgttattttagaattttatatatcaaagagaaaaaagagaagataagaacccgtccataaacgtttatacgaagatacaaaagaaaa

SEQ ID NO: 163 - DNA, 661 bp, Homo sapiens
  misc_feature [331]..[331]: Chromosome 1, SNP identification no. = rs2049064
  misc_feature [331]..[331]: allele = c, a
  misc_feature [331]..[331]: n is a, t, c or g
aagacatagtgtaataacacttttaattaaacaaagtgacgtctttataacgatacaaacttatatccctagaaaagatctgagattacacccacaatatatattgtaccacgtccctgacataatagaaggatgttagatttaacaaaaattagaagatagattttttaaaaaaaataatagaaggatattagattttgggtcgaccgaggtttccaaaaaaaaatcccttaatgtttagggatagtgaatactatacatcgtatgagaccattgattccgattataaacgaaggggcgaatgatatcacccctttacacaaggactctnactcactagtagatcggtaatgcgaaagatcgagtagaacggcgtcaacactaggatactgatttatattggttatcttatatttttaccatataagtattaaaatagagtaaataacagtattattgaagcccttcagtgataccaatcgtcataataaaaactttagtctttatatctccgaatcttcaagaacttcgagtatttactcttggaatctccaccttttattaagaagactacagtttagggtacgaggaggatggtgttattttagaattttatatatcaaagagaaaaaagagaagataagaacccgtccataaacgt

SEQ ID NO: 164 - DNA, 661 bp, Homo sapiens
  misc_feature [331]..[331]: Chromosome 1, SNP identification no. = rs1607634
  misc_feature [331]..[331]: allele = g, in linkage disequilibrium with rs2049064, respectively
  misc_feature [331]..[331]: n is a, t, c or g
gctaatatagagaaatataatagctttttctatattgatttagtatcttgtgatcttgttaaattcactttttagtcctacttgcttttttatagattcttaggatcttctatatgcataatcatgtcattgacaaacaaagacacatttacctatttatttccaaagcatatgtcttttatttctcttacttttcttattacactggcttgaacttccactaaaatgtggaagaggaacatgagagaaattgtaatcttttttcccaaccttagagctattaaatacgatgtcagatgaaggttttggatatactctttttcagtttgcntaagtttttatttattcccgttctcttaatagctttttaaattatttaatattgagttttgttaaattagttttcttcacatattgaaattattatatagtttaactcctttgttgtattaatgtgacaaaatacattgattgatactcaagttataaaccaactttgcattccagagataaattttatttactcatggtgtgttatattttgtgtttattgctggatttaattatgataatattttgttaaggattttgcatttgtattcataaagtatattcatgtgtaattttacatgcattctgtaatgccagtaccataaatcag

SEQ ID NO: 165 - DNA, 661 bp, Homo sapiens
  misc_feature [331]..[331]: Chromosome 1, SNP identification no. = rs1519874
  misc_feature [331]..[331]: allele = c, in linkage disequilibrium with rs2049064, respectively
  misc_feature [331]..[331]: n is a, t, c or g
tctactttccttgagtataattttttggtagcatttaagaaagaagcttagacttaattttagacactttttttctaaaatatgcatgtaagagaataaatttctcttcatgtacacctaaattttgatatgttatgtttttcattgtcactcaattagaaacattttctaaatcttcatgtaatttctacttgacctgtgggcactttgacctatctagtctagttggttgatgtttgttgatatgtgtttttcttctaccagttactgagagaagattctagaaatttataactataattgtaaatttgtctatatctctttcagtttngctagttttactctcatgtatattagactacttgatatttgtcccacatatcaatgagaccctttatgacactttggtttctttttctatgtgtttcaattcaagtaatttctattaatatatctttaagatttgtgttagtctgttctcactctgctacaaagaaatacctgaaactaactaatttattttaaaaaaaggtttttaatttgctcacagttctgccagctatacaggaagcatggctgggaaggcctcaggaaactgtcaatcataacagaagggaaatcaggcctgtcttacatgggcaaagcaggagaaaagagagag

SEQ ID NO: 166 - DNA, 661 bp, Homo sapiens
  misc_feature [331]..[331]: Chromosome 1, SNP identification no. = rs2030341
  misc_feature [331]..[331]: allele = c, in linkage disequilibrium with rs2049064, respectively
  misc_feature [331]..[331]: n is a, t, c or g
gcttcagagtttcagtttatagcttaattatgtttatgttttcctttaaatctttacatacatttttaatcactatcttaaagtcattgtctgataattctatcatttgccatttttggatctgtttccattgacagatttttctccttgtaatgggacacatttttctgctttttctcttgtttttaaatcaaattctggataatgtaaattttgtgtttttaaattgttgaaatttttttaaaatataaagaatgttggacttccaatgttgggtgcatttatatttataattattatgttctttaaatgaacatcatatcacctaaanatgtaaagcaaatattaaaagaattaacaggagaactagacagtaatacaataacagtaaatgactttaatactccaatttcaacaccagagatatcattaatagaaaatcaatagtggacttgaataacagtataggccaaatagatctcactgatatatatatgcacatacatatatatatatacacacacatatatacataaatatgtatacacatatatacatacacacacacacacacacacacacatatatatatagaacatcccatccaataacagtgaaatacgcattcttttaaagcatacaaaaaacattcttcaggata

SEQ ID NO: 167 - DNA, 661 bp, Homo sapiens
  misc_feature [331]..[331]: Chromosome 1, SNP identification no. = rs908953
  misc_feature [331]..[331]: allele = t, in linkage disequilibrium with rs2049064, respectively
  misc_feature [331]..[331]: n is a, t, c or g
caggataatttacccatctcaagaacctaattgcacatgcaaagtccttttgccatgtaaaataacatattcacctgacagtcagggcttggacatctttgaggaacaatttttcagcctattacatttggcaatctgtgtaaaaatcacacaagaatctatttatgtgaagattttggattttaaattaagcaggaagggagaaattgtatgaattggccatgggagtgagctaacagagaagactgtatttgtcaggttctccacagaaacagaaacaataggatggagacagaagaatatgggagaagaaagtgagcaagagaaaaanatttattttaaaagattagtgcacataattttagaggctggcaagttcaaaatatgcagagcagcctggcaggctgggaattccagcaggagtcaatgctgcaggcttaagtagaaggcagttgggaggcagaatgctttcctcttctgaggacctcagtcctcagtcttttatcttaaggtcttcatctgattggatgaggccaacccacattatggagagtaatgtggtttattcagtctactgatttaaatctaaaaaatacattcaaatacattgacagtaacttctggactgctgcttgaacagcagctgagcaccatacactga

SEQ ID NO: 168 - DNA, 661 bp, Homo sapiens
  misc_feature [331]..[331]: Chromosome 1, SNP identification no. = rs10881449
  misc_feature [331]..[331]: allele = c, in linkage disequilibrium with rs2049064, respectively
  misc_feature [331]..[331]: n is a, t, c or g
agaataaggtaagagagaagaaaatgaaaacaactaaagtcattataaatggcgagaagtttgatggtaagttatattcagcttttggtatactctcatatttcccaggctcacaattattgtcatgcaagatgccaaggaacgcatggaaaatggcaccacacacaaagtgatatgcatcagagttcttgcatttaaatattaaagcatagaaaatcactgtcaaattctagcatgtcgatgtgtctggttgaaagggatagcagactgaatcttgtcattatctcctgctgtgcatcagaagctacatacccattgtagagtccagtcncctctcaagcttgtggttctgggagcttcctttaagataacagcaggtgttttgtttttaagcacagggaaaaaagacaattttaaatagttaagttgatgatacttttaagagagaaactgcatagaagaaagtaaagtggtccaatatctttgtttgtggggattatatatattcaggggattgaaaaatacaagaagacacaaaatgcatgtgacagataagagaggaaccaggagagttcgtataagaaaaaataggaagagaaatggttttaagaaggaggaagaaatgaaaagggttgaatgctgcagaaggattagagaagat

SEQ ID NO: 169 - DNA, 661 bp, Homo sapiens
  misc_feature [331]..[331]: Chromosome 1, SNP identification no. = rs1607635
  misc_feature [331]..[331]: allele = t, in linkage disequilibrium with rs2049064, respectively
  misc_feature [331]..[331]: n is a, t, c or g
acagccacttgggaaggcaggttggcagtttcttataaaactaaacatattcttaccacataacccagcaatcacactacttgatatgtacttgaaggagttgaaaaagtatttccacacaaaaacctgcactttatagcaggtttatttataattgccaaaacttagaagcaaccccaaatatccttcattaatccaaccagtgaaatataagttaggactaaaaattgatctgtctagctctggaaagacaagaaggaaactttaaatatatattaccacatgaaagaagccaatctgaaaggctacatatgtatgattccaattatanaacatgctgaaaaaggcaaaactatgaaggtagcaaaaagatcagtggttgataggattttagggaatgtagggaggttacttcaggcagtgaaactactctgtatgatacatttgtgtagacccataggatatacaacaccaagaatgaatcctaatggaaaatatgtgtgctgggtgataatgatgtgtcaatgctggtcatcagttgtaagaaatgcaccactctgattgggaatgttgataacaggggaggctatgtatgtgtagggacagaggatatatgggaaatgtctcaattttgttatgaacctaaaactactctaaaaaa

SEQ ID NO: 170 - DNA, 661 bp, Homo sapiens
  misc_feature [331]..[331]: Chromosome 1, SNP identification no. = rs1156426
  misc_feature [331]..[331]: allele = c, in linkage disequilibrium with rs2049064, respectively
  misc_feature [331]..[331]: n is a, t, c or g
ctatagaggtagataggggtcaaatcagtccaggtcatagggaaattttgtcataaatcagaagataataaatagaaactaccttgatcaggtttacatttttgaaaaggtcattctgtctgcaatgtgaagattaatgtggagggggtgccaaaataaatggaatttagaccaatagaaaagttattgcaggatagaggtgattgtaaattagaaaaggtagtgatgacgagaacagtaagtgcataagagatatttagaagcaaagtcaaaaatcttgttgatgcattgaacatttcatatgtgaccctcacttgattagtagacacantgatgattattgcatctgtgtgtgtatggatgctgtagtcatatttacacgctaacaaattactaccaataaattacagcatgaatttccctcaaccttaagaagagatggaatgttcataatgaggaagaagtcttctgattttctaaataggtaggtatcagggtattatgtgaatttgacaacaaaattcacagattatgtaacttgctttgcactgtcattgagtctgcaagctagtgaacaatgtgatcatttattctaaaaggaataagcacccaaccaaatcagagagctgagtaatggctccagtaatattctcatcagaac

SEQ ID NO: 171 - DNA, 661 bp, Homo sapiens
  misc_feature [331]..[331]: Chromosome 1, SNP identification no. = rs7530116
  misc_feature [331]..[331]: allele = c, in linkage disequilibrium with rs2049064, respectively
  misc_feature [331]..[331]: n is a, t, c or g
ataagtatcattttctcatatcaaccttccccaatcccttataataggtcatgtcccctattaatcacctttaagtccccattcttctccttcatggcaccactcaccattgtaattaagttataaactgggtaattggttgtttaatttatattttctagcatactttgagctccatgagagcaggtaccactctgcccctattcactgatatctgctctgtgcttaaaactgactgaaacacagaaatcgtgaaatgaatatttgttgtaaattaatacatagtaaacaatgtaattaaggaatatgaaaaatcttagatgagagaagnaatttgcagcttcagattcatgtctatttttcagttgaggaaatggagacccagagaagttaagtgacttgctcagtgtttcatagataataagttgtcagagctgtattttaatcccagttccctccaactccatagcctgtgctttgaaatggaaacattgtgccacgctgcaccatttaagcaatgatatattcatttaaagcaccagagatcacattttagggagagaaaaagtttgtagtatgagatgaatcaatcagccatatggaaggaggaaaaaaagagcaggctaaaaagcttcctttcactttgtacaatatgaattgt

SEQ ID NO: 172 - DNA, 661 bp, Homo sapiens
  misc_feature [331]..[331]: Chromosome 1, SNP identification no. = rs12094371
  misc_feature [331]..[331]: allele = g, in linkage disequilibrium with rs2049064, respectively
  misc_feature [331]..[331]: n is a, t, c or g
tggtaaagagcatgaagtctggaaccaggctgcttggtttgaactttggcccctaacacttactagctgtgtgaccttgggaaagctactcaagctctctggtctcctttttatcatatttactctggtctcctttttatcatatttacaatagctataaggaaagtaacatgtcttatctcagagggttgtttggaagattcataagttaatatgttaggtccagtttcagtcagggtaagctaactgctgtatcaaaggaaaagccccaaatcctagagccctatgacaaaaaaagacttatttcttgctgttgtcactataaaactgnacaattcaaggatacagtcttcttctacctgggagcatcattgtcccacaggaccttggcatcttccactgtattctctgttttcgatacaggtaatcacaacacagaagagtgaagaaggacacaggctcttagccaccatggcctaaaactgtcccacacctcttcaactcacatcctactgtccacaaccagtcatcagtcatgtgcaacgttcacacataaaagccctggaaaatgaaggccagtgatttgcctaggaaaagtagtaagtagatttggtgccagtcacaggtggagactcgattgctgctattagacctctgttct

SEQ ID NO: 173 - DNA, 661 bp, Homo sapiens
  misc_feature [331]..[331]: Chromosome 1, SNP identification no. = rs1519875
  misc_feature [331]..[331]: allele = g, in linkage disequilibrium with rs2049064, respectively
  misc_feature [331]..[331]: n is a, t, c or g
tataattaaaatagttcttgatacttaaaatgtcatatttgctggactaggcattctttttgtcattttttcatacatcatggttcagagtctttcatcagttctcagactttatagtgttaccatcatcttggatcctaaccaatgcaaactgtattgcttttcgtttttagtatgcacacaatatagactcatatcaattggttgcttttttaatatctttatttttcttcatcttatgttgtccctgaatccatgccttgcatttaactaagacttagcttcaggacatgccattgatcagagatttcaaaatatgagttttgactcntgggtgagacaaggatatttcagtgaatctaaaatgtgtttctataatggaatagaaaaaatatatatatatatgtatagcttgttgttaggtttaaatgagtttgtatatgtaaatcattagaacactaaattttcaaaatgaagaaaaccttataaaggaatgaaattctgacatatgttacaacatgtatgaatctagaagacattatattaagtgaaataaaccaatcacaagagaataaatattatatgattccacttatatgaggtcaagagcagtcaagttcacagagacagcaagtaaaatggtggttgccagggaatggag

SEQ ID NO: 174 - DNA, 661 bp, Homo sapiens
  misc_feature [331]..[331]: Chromosome 1, SNP identification no. = rs1519876
  misc_feature [331]..[331]: allele = g, in linkage disequilibrium with rs2049064, respectively
  misc_feature [331]..[331]: n is a, t, c or g
aaagatatatagcatatactgttagatagcctagaataaatattaatttcatatttatcctgtgcctttttacttctctgtggtctttccttaataatgtagatacttatttcatagttattgatggtcccttctttcaatatgagagtaaggaacttggagtaaaaagaatgtatgcaatgaaactgttaaagccttttttagagaaatgaaacacaaacataagaatgacagctcatacacagtgaaattgagcttcccttttacctctgtgttttatggcagccgcagatgcctgaaattacagatgtgcctataaacccccaacacnctaaaacctttagttgctcctttgaaggtgtcatttgtatagctacatctttaaaaggtggcaatttttcccatatcctgaaaacactcacccattaagccctgttgtattgctcttaccttcttgctattatcatattactctttattcttgacatccaatctatcgaaagtgagagacttgctgtgctgtttccattcacgtgctgccaggttgctggggacgaggataatctgtcattttgggtcaggagggaggctggaaacagttagatgaatagtgagtcatggtctttgcttttatgattttttccattttgaactaactttc

SEQ ID NO: 175 - DNA, 661 bp, Homo sapiens
  misc_feature [331]..[331]: Chromosome 1, SNP identification no. = rs10881450
  misc_feature [331]..[331]: allele = c, in linkage disequilibrium with rs2049064, respectively
  misc_feature [331]..[331]: n is a, t, c or g
gggcaagttacttcctctttctagacctcagatttcccatctctaaaatgagaataatatcatttaccttatatcggtgttggaaaacctaaatgagagtttgtactttgaaatgctaatgtgttgggcacctttaaaatcatcacaaaaatgtggagccttctcccttaggttatatttttccttctcagtattctaaatatagcgcatatagatagatagatagatagatagatagatagatagatagatagattgtgcatataaaaagattgtgtatatataaagattgtgtattgcttaggcatttctatatttactccagcaatcntttttttgtgtgtacttcataaatctagtttaggctactgcgatgttaggtatctatttagttgtttttatacttttattagtcttcctgataatccacaagtatggaattagatactatctgtgattgtgaatattttttcttgttataactctaactaaatttaaaaagaattacagaaacaaaatttggaaagatccttagaggacattactttcaaagccagctgaataaaacttgcctggggagcttggtaaaaatacagacatcacaatccaactccatagatttggatttagtaggtatggaaaagtacccagaaactagtgc

SEQ ID NO: 176 - DNA, 661 bp, Homo sapiens
  misc_feature [331]..[331]: Chromosome 1, SNP identification no. = rs2102909
  misc_feature [331]..[331]: allele = t, in linkage disequilibrium with rs2049064, respectively
  misc_feature [331]..[331]: n is a, t, c or g
ggatcatgaggtcaggagttcgagaccagcctgaccaacatggcgaaaccccatctctactaaaaatacaaaaattagctgggcgtggtggcaggcacctgtaatcccagctactcaggaggttgaggcatgagaatcagttgaacccgggaggcagaggttgcagtgagctgagattgcaccactgcactccagcctcactgacagagtgagactatgtcaaaaaaaaaaaaaaaaaaagagagagagagagaaaaagaatgagatgcagtcatttgcaacaacgtggatggaattggagatcattatgttaatgaaaataagccaggcncaaaaagacaaacatcacacgttctcactcatttgtgggatctaaaaatcaaaacaattgaactcatggacatagagagtagaaggatggttaccagaggctggaaagggtagtagaagggtatgggagaggtgggaatggttaatgggtacaaaaattatatatagttagaaagaatgaataagacctacccatctgacaagggatagaatatataaggagttcaaacaactctatagaaaaaattataataatctgatgaaaaaatgggcaaaagattcaaatagacatttcttaaaagaagacatacaaatggcaaatatatagtta

SEQ ID NO: 177 - DNA, 661 bp, Homo sapiens
  misc_feature [331]..[331]: Chromosome 1, SNP identification no. = rs7511900
  misc_feature [331]..[331]: allele = c, in linkage disequilibrium with rs2049064, respectively
  misc_feature [331]..[331]: n is a, t, c or g
tggaaccaaaaaggagcctgtatagccaagacaatcctgggcaaaaagaacaaagctggaggtgtcacgctacctgacttcaaactaaactacaaggctgcagtaacaaaaacagcatggtactggtaccaaaatagatatgtgggccaatgagaaagaagagaggcctcagaaataatctcacacatctacaaccatctgatctttgacaaaccagacaaaaacaagcaatggggaaagtattccctatttaataaatggggttgagaaaactggctagccatacgcagaaaactgaaactagaccccttccttataccttatacaaacnttaacttgagatggattaaagacttaaacataagatctaaaaccataaaaaccctagaagaaaacctaggcaataccattcaggacgtaattatggacaaagaattcatggctaagacaccaaaagcaatggcaacaaaaaacaaaattgacaaatggaatctaattaaactaaagagcttctgcagagcaaaaagaaactatcatcagagtgaacaggcaacctatggaatgggagaacatttttgcaatctatccatctgataaagggctaatatccagaatctacaagaaacttaaacaaatttacaagaaaaaaaaacaaccccat

SEQ ID NO: 178 - DNA, 661 bp, Homo sapiens
  misc_feature [331]..[331]: Chromosome 1, SNP identification no. = rs10465780
  misc_feature [331]..[331]: allele = t, in linkage disequilibrium with rs2049064, respectively
  misc_feature [331]..[331]: n is a, t, c or g
atagcagactagtttttctcataataaaatatttctagagagagggtcagttccaagtttggttccaaagttcagcccagtcaaggtcctgagttggatttttacaattttctattttggccttaaggagactacagtagcaccaagaatcttggaccacataactattttcaaaggtaggaaacacagggcattgcctctcccttctcagagacacccatcagctttctcctttatctcattttcacccctacattatgcctgactctcctgacatcaggagacctctggatgacagcagaacaaaatcaggactctgttaaccaggaanggggagaaagaagtaatggcctttggaaaagcaatctacactgtctactatatccatttgtttaaatttccatataggaagaaatagagatgagagagaataagagaaaagaggaaagaaggaaaggagaggagaggagaggagggacggagggagggagggaggcaggaaggaagaaaaagaaagaaagaaaaagaaagaaagaaagaaagaaagaaagaaagaaagaaagaaaggaaggaaggaaggaaggaaggaaggaaggaaggaaggaaggaaggaagaaagaaaaagaaagaaagaaggaaggaaggaaagaaagaaggaaag

SEQ ID NO: 179 - DNA, 661 bp, Homo sapiens
  misc_feature [331]..[331]: Chromosome 1, SNP identification no. = rs11184996
  misc_feature [331]..[331]: allele = c, in linkage disequilibrium with rs2049064, respectively
  misc_feature [331]..[331]: n is a, t, c or g
taataaaatatttctagagagagggtcagttccaagtttggttccaaagttcagcccagtcaaggtcctgagttggatttttacaattttctattttggccttaaggagactacagtagcaccaagaatcttggaccacataactattttcaaaggtaggaaacacagggcattgcctctcccttctcagagacacccatcagctttctcctttatctcattttcacccctacattatgcctgactctcctgacatcaggagacctctggatgacagcagaacaaaatcaggactctgttaaccaggaatggggagaaagaagtaatggcntttggaaaagcaatctacactgtctactatatccatttgtttaaatttccatataggaagaaatagagatgagagagaataagagaaaagaggaaagaaggaaaggagaggagaggagaggagggacggagggagggagggaggcaggaaggaagaaaaagaaagaaagaaaaagaaagaaagaaagaaagaaagaaagaaagaaagaaagaaaggaaggaaggaaggaaggaaggaaggaaggaaggaaggaaggaaggaagaaagaaaaagaaagaaagaaggaaggaaggaaagaaagaaggaaagaaagaaagaaagagagggcga

SEQ ID NO: 180 - DNA, 661 bp, Homo sapiens
  AMPD1
  misc_feature [331]..[331]: Chromosome 1, SNP identification no. = rs2010899
  misc_feature [331]..[331]: allele = c, in linkage disequilibrium with rs360659, respectively
  misc_feature [331]..[331]: n is a, t, c or g
tggataaaataaataaacaaacaaataaataaataaaaaactctacctcagaacgacacaacgggtccgacctcacgtcaccacgctatcgagtgacgttggagacggaggacccaagttcactaagaggacggagtcggaggactcatcgactcaaatgtccacgggtggtgggtagactgattaaaaacataaaaatcatctctgctccaaagtggtaaccggtccaaccagagcttgaggactggagttcactaggtgggtggagtcggagggtttcacgatactaatgtccgcactcggtggcacgggtcggaatttttggataaantctattttgatattgaaaccaacatataaggggagttagagtttaatctgaacaggaaaacgactgactatcatccagacggagacttaaggaaaccctctactttacaccgtctgcttccggatgttggaacagaaaggatgtgtaattatttcgtgacgactctttgttcgtacaaaaagacctggacaattcttctttcgtactataagtagaagagttctcagaacgtgaaggacacaattattatcattagaggttgaagacctgtcatgacgtatcaaaatttcataaaaaacaatttagaagtattgttaagagacttcaact

SEQ ID NO: 181 - DNA, 661 bp, Homo sapiens
  NRAS
  misc_feature [331]..[331]: Chromosome 1, SNP identification no. = rs969273
  misc_feature [331]..[331]: allele = g, in linkage disequilibrium with rs360659, respectively
  misc_feature [331]..[331]: n is a, t, c or g
catacaaatctaaagaaattcattttatttgtcgtgtttattttgtcaggtcaagtatcgaatcactttatgtgacccatgaattagacatcggaggaccgacgtcatctcaacagtaaactcaatgacacaaaagaattagaaaaggtccttgtgtcactggtataaagaaaagacgtccgtatatcttaaaccacccaaaagaaaatacatcccactataacctatgaaaaacaaacactaatatataatcgttaaactccctgtttggtctatccgtctttacccgaacttatcaatctacgaataaattggaaccgttatcgtaacntaagggacaccaaaaattatttttaacttgaagggagggagggacgggggaatgggaggtgtgggggtcctaagaatgtcttttgttcaccaatatctaccactttggacaaacaacctgtatgacctatgtcgacctgttcttctcatgtcacggtactctctggttatgtactcctgtccgcttccgaaggagacacataaacggtagttattatcgttcagtaaacgcctataattggagatgtccatgatcctcgtaataaaagagactttcctactagaaacacaagacttagaaatacccctttactccaatggtgtgatccct

SEQ ID NO: 182 - DNA, 661 bp, Homo sapiens
  NRAS
  misc_feature [331]..[331]: Chromosome 1, SNP identification no. = rs6671984
  misc_feature [331]..[331]: allele = c, in linkage disequilibrium with rs360659, respectively
  misc_feature [331]..[331]: n is a, t, c or g
tagatcatataaaaaatactttcattttggttttatggcaacaggacttttacttgtattttaatgtcatcacacttggagaactctctggagtactggaagtgctctatactgttatctgggtggtagctacatgactatatagaaacgcaaaaagcactgggctgtagacataaaatttatgtattttacttatgtaaattgctcaataaatcaaacatttaaaaatatttaattaaaatattaaacatttcatgtaaaatattaaagctgttaagctcaaaataaagattttgccaagggttagcaaccaattttttatagtggctanattagagttagttttcatcaattaaacacgagtagccagatggtagggaggccaggtgttgattaaaataatctctaaagttaggcatttctaaactgaacaaaattacaaaaccctttatttatttatctatttatttattttttgagacgaagtctcgctctgttgcccaggctggaggtctgtggtgtgatctcggctcactgcaccctctgcctctggttcaagcgattctcctgcctcagcctcctgagtagctgggattacaggtgcctgccaccacacccagctaatttttgtatttttagtagagacggggtttcaccatgt

SEQ ID NO: 183 - DNA, 661 bp, Homo sapiens
  D1S155E
  misc_feature [331]..[331]: Chromosome 1, SNP identification no. = rs10489525
  misc_feature [331]..[331]: allele = a, g
  misc_feature [331]..[331]: n is a, t, c or g
aagtctaaaagctagtatttcacaacagtcctctgctgatgaccctaggaagtttatataactgctaaaaatgtgttatgttacttaaaatatatttacattttcagtactcagaagtttcaccttaaagcttaaatgaaatcctaaatgttaaatactaccatggaaccaaatgagaatgtcacagctcccatcagtactttattagctgatgaacaattttaaactgcatttataaattaaaacaaaaaatactgtcatttacaatcccattgcctaaattttaagcactatgggttgccaatattcacaggactatcttcttcccaanttcacaatatgagccaaccaaaaatacttttgtcccatactcaatgagccagtaaacaactaggcgggcacaggcaaaaacaatttagataaatttgacaccccacctcctttttttttgttcgaattctggctccctcacataggttcctttttccagatcagagaccaaaaaccattttcctaaagggccggagagtattattttaggtttgcaagtcatcctgtctaaccaactctgctgttgtagtgagaaagcaacgaaaaacaatatgtaaacaaatggttgtggctgtgatcacaagaaaaggccaccatatatgctgagccc

SEQ ID NO: 184 - DNA, 661 bp, Homo sapiens
  D1S155E
  misc_feature [331]..[331]: Chromosome 1, SNP identification no. = rs2007231
  misc_feature [331]..[331]: allele = c, in linkage disequilibrium with rs360659, respectively
  misc_feature [331]..[331]: n is a, t, c or g
gaagatagatggggaaaaaagaagaagaaagtagagaatgaaaggaagcctgagctagaaacgagaaataggatcctcatagaactctagctattaagaaacagattatgtacatatgtgtagtgtaggggggaaaaaaacagtaaacttttacaggaagcaaaaatacagaactgaatgcttactgatttaaatactaatgaaggaactgaatatttgattatcatacactcaacagtaaaagctttggttatcagagtttgttgttaagtctatctcaatataactcatagttgctcatgtatcagtcatgtgctcacaaagcagtcangttttcactatttaaacccagactgacctcattttcaaggggtataaaaataaaaagcaagcatgagagaggtcacttttccttaattcagttttaaacctaaaaacaactgcaataagcaccatattttaaaactttataggtgctcatctgaagttatggcaaatttcaaacagcctgatagtgatgatccttaccctcctccacaatctcaatcattccttggtactcagtctgtgttggatcaacactcctcagggggcgaattactttgccagagtaaatggtgggatcagcttcctcagtaatgccattcactacaaaacaaag

SEQ ID NO: 185 - DNA, 661 bp, Homo sapiens
  D1S155E
  misc_feature [331]..[331]: Chromosome 1, SNP identification no. = rs2144428
  misc_feature [331]..[331]: allele = g, in linkage disequilibrium with rs360659, respectively
  misc_feature [331]..[331]: n is a, t, c or g
tcctacccaagaagtttaaaatagttcaaaacgactttatataaaacacaaattctctttatgtacttatagaacataaactttcgtcgaataattttcacagacagttcgagaaacaattagtttcggaacaattagatcgacaaatttgcaatctattttgtacgaattattttagcaataaccattctttcaattttgtcaatgatgactttgtaatagtttcattttcgtgtggtttctaaaatgcaacaacaagtaaaaaagagtatgaattatacaaaccaaaaacctatcgggagatctctttaagtcttagatattccttatntctgactttctattttcaaactaggaaacacttttcaccctactctgtatttacaaaaccacttttagttaaagtaacttcattattgtttcctataaaccttacttttcgtacgcgaccccctcaatatccagaacaaaagactcaattcctctaaccacaccttcactataccacaattactcgtaggaattaaaagtgtccaacttaaatcataatcactgtttgtctccggacctgtcgtccaacgttgaacacacgctgaaaatccagcattaagattgaggttctccgagaacccaatacaccgttgagacttcctattaaaac

SEQ ID NO: 186 - DNA, 661 bp, Homo sapiens
  D1S155E
  misc_feature [331]..[331]: Chromosome 1, SNP identification no. = rs6663115
  misc_feature [331]..[331]: allele = g, in linkage disequilibrium with rs360659, respectively
  misc_feature [331]..[331]: n is a, t, c or g
gttagccaggatggtctcaatctcctgacctcgtgatccgcccgcctcagcctcccaaagtgctgggtttacaggtgtgagccaccgcacctgacaataaggtctaaattctttagagcagcaatcaacaccctcccagtctagctggatcctgatttttcatccttatttctcctaacctccctcaccaacaaaaacccacacacaaaaccaaaaaaaaaaaaaaaaaaattcctgtcggactagttactcattgcttcctaaagaaaccctgaatttttctcatctatacttttactctgtgaagaatgctctttcctgtctccatctnttagtaaaaccatcacataccctaccagttaattttcaccagagcactatcgctgaccttcaatagcaatattttatattctatatgaattacttgtttctataaaactctcaatttgttattaacttgaaaggagaattcatctcagacatctttctatttcctatttagtggatttttcaataaatgaaatttaaatgtgtgaactgaggatacacccaactttgaaagttttaaattgcctggaagacagtactatcattttatataactagttctctacttggaatgagtttgcctcccaggggacatttggcaatgtctggacac

SEQ ID NO: 187 - DNA, 661 bp, Homo sapiens
  D1S155E
  misc_feature [331]..[331]: Chromosome 1, SNP identification no. = rs4140445
  misc_feature [331]..[331]: allele = t, in linkage disequilibrium with rs360659, respectively
  misc_feature [331]..[331]: n is a, t, c or g
ctttatagttgtgatagagaacaatctattcctgtcataaataccagtttgtaaaaagtatggtctaatataattatgtacgactagagagctgaacgaccagagaatctcttcgaggcagacatgataaatcttcaatcctaaagtttattcttacacgtaacgtcagaaagatactcccagacactttgaaaccactataaacgatgactgcagacaaagaaagagagatgacagaagttacaatcgaagaactcctttcttggaatgaaatataggtacggatgtaaacgtcacgtataaacacttgccatatgtcacgtgtaaacanttaccaactgtacggatgacataacaatccgtaacgatcacgactttatattgcttacttattctatgattacctgaattactaaatcttgttaaacaatgtgttatagtgttatatccgattttctatgattattttataattcttatattgacttcgacaagggaacctccattcctcctcccatttctttcggatgtcttttccctataaacttccactcatcatggaacaattctccatcttctctgtaaccatctccatatctccattgtcttaatcgtctaagtcccgatgcactttcgtgtaccatatataattcaacaagta

SEQ ID NO: 188 - DNA, 661 bp, Homo sapiens
  misc_feature [331]..[331]: Chromosome 1, SNP identification no. = rs3121503
  misc_feature [331]..[331]: allele = a, in linkage disequilibrium with rs360659, respectively
  misc_feature [331]..[331]: n is a, t, c or g
ggcagtagcttttaaagggtggtcactttgcccagatcctgttttttgtttagactttgtatggcaagtgtttcataaatgattagaagaggtggtttctgtttcattaatgaggatgatgataatggttaattactaaactggaataaacagtcccaaaccagaacacagatgaaaagccaattatgtagaaataattcagctgtattaaatatgatttacctttcctgttacgaaccttaaatatgttttaaaccattgagaaaaaaaccactcaaccatctatcttgtaactataatttatactgcttttttgggggattgaaagctntatctagttaagtttttaaattcagtgaaataactccaaaatatgaaatagaattcacttgatctaaacataaagtgaaaatcagtactttaggagacattatgtctggttgcataatatgagttccatctgtagggcctggcttaaaaaaaatcgggtgagagtcatatgacacagatttaaccatttcaaagtgaacaattcagtagcgtttagtacattcaccataccatgcaattaccatctccatgtagtcctaaacctttcatcaccccaacaggaaagcccatacccaataagctgtgtactccccatcctcaagtcctggca

SEQ ID NO: 189 - DNA, 661 bp, Homo sapiens
  misc_feature [331]..[331]: Chromosome 1, SNP identification no. = rs1286555
  misc_feature [331]..[331]: allele = g, in linkage disequilibrium with rs360659, respectively
  misc_feature [331]..[331]: n is a, t, c or g
cgcatcccccttgtagtacatgttatcttttcatttgtggtttgaagaaagaaggagttatacgaaatagtacctctttttttagatcacctgtgggaagaagtgggtcaacagtaatgtcatttttcgttttgagtcttcgtacggactccaaaaactgttgtacattactcgtggtactactaattaagtttgttctttgaggatctgtaaaagaatatttccgtctataataacaaaccgaccccagttactgatcgtttgagtgtctacactaagtttggatccgtaggatctctcttacgataaagttgatatcttacgaagaagngatgacatagaataatattcttgtttcagttctctggttttatacatagaccttttaagaatgtatgggataattagacttcagtttaaaaactcgtagagacatcattctaattttacaggtgaaccacagtcccgtgtaacttacgggacctaatgtcacctagacattagggtcctgaaaccctccagttctaccctcctagagaactccggtcctccgggtctcgtcggacccgttgtatcgttctgggaagagatttttgttttgttttgttttgtttttttcagttgaatcaaaacgttattaaaatttcagtctaagattgag

SEQ ID NO: 190 - DNA, 661 bp, Homo sapiens
  misc_feature [331]..[331]: Chromosome 1, SNP identification no. = rs3121506
  misc_feature [331]..[331]: allele = g, in linkage disequilibrium with rs360659, respectively
  misc_feature [331]..[331]: n is a, t, c or g
ggcagagaagtggaatgctatctagattgagttgtggggtctggggagattttttgctttatttttttcacaaacttctggtcagatagatagaaaacatttctacccattgtgtttcactacctcccctcgaaattactcttattaatccttagaatctgatttcattcttaccacaccagtaaagctgctgtgatcaaggtcatcaaagaaggcacttttggttgttcaaatcatccaattccagtgcatttttcccttgtccattttcactgtagagactagaaaaattaaacggtctctttcccagagcttcccttgcagtttaggntggtcacgtgacatagttctgactaatgagatgtaaaagaattctgggggtaagggcttcttggaaagttgttctgttttcttttattagtttatttattttagtttattttactttagatgtttatagataactatctttacaaatagttagcatatcaaggttctaagttttaaaaaatttcttccattcaagaataggtttagaaaacctattcttagaccaagattcagttcatctttaatgtgtccatggatgaagaacctagtgaaggatgtaatgtaacttcacttgtatatgatgttgttcaatttacctaacactttatgg

SEQ ID NO: 191 - DNA, 661 bp, Homo sapiens
  misc_feature [331]..[331]: Chromosome 1, SNP identification no. = rs3121507
  misc_feature [331]..[331]: allele = c, in linkage disequilibrium with rs360659, respectively
  misc_feature [331]..[331]: n is a, t, c or g
attcttaacatttctctatttattctctatttatttctacactgtagtagaattttctattatttgctgccaaatgcaatttctcattctaatcatccaatcattagaaaaacctacagattctacagcaaaatgtatcttgaatctgtcaacttatctccatgccctacttcaagtcacagccatcatcctagttttatatactgtgatagtcacctaactagtcacttcactttctctctttctctcctccattctagtccccatataacatcctgagctatttggaaattaaattcactcaagaagttaggagtagaggagaattatntcaatttgataaagagcatgtataaaaatcctacagctaacatcactgaatgaaaaactgaatgctttctctctaagactaggaacaaagtgaggatgtcttctcacaccattcttattcaatatagtgctggaaattctagccattgcaataagtcaagaaaaagaaatagaaggcatatagattggaaggaaagaaataaaactgttcccatttgccaatgagatgatggtctgtataaaaaattccaaggaattaaaaattcactctggaaataacaagtaagttcagtaatgttgcaggatataagacaatacagaaaaatacaat

SEQ ID NO: 192 - DNA, 661 bp, Homo sapiens
  misc_feature [331]..[331]: Chromosome 1, SNP identification no. = rs6689326
  misc_feature [331]..[331]: allele = t, in linkage disequilibrium with rs360659, respectively
  misc_feature [331]..[331]: n is a, t, c or g
caagtccttcaatgggtgaatgtttaaacaaactgtggcaagcccatacaatggaatattaatcagtaatgaaaaggagtgagctcttgatatatacaacttggatgactctccagggaattatgctgagttaaaaaacccaatcctatttgcactgaaagggctcctagttaaaaaaaaaaaaaagccattcataaaagattatgtaatgtactaacctggaaataacaaaattttagaaatggaggacggttagtggtttccagaggctggaaatgggaagacggtggaggaagaaaggtgtggtttaaaacggtacaacatgaggganccttgtggtgttgcaactgttcagtacctgaactgtggcgatggacacataaacttgcaagtgacaaaaatcttatagaacttacacacgtacataactgcaagtaaaactggggaaatctgaataagataggtggtttgtatcaatgtcaatgtcttgcttgtggtattgtcctatagttttggaaaatattaccattgaaggaaactggataaagtgtaagaaagatctctctgtattacttcttataactgcaggtgaatctacaatgatctcaatgagaatttcaattaaacaaaacaacaagagaaaacaaaacaaaaaatacgc

SEQ ID NO: 193 - DNA, 661 bp, Homo sapiens
  misc_feature [331]..[331]: Chromosome 1, SNP identification no. = rs3126216
  misc_feature [331]..[331]: allele = g, in linkage disequilibrium with rs360659, respectively
  misc_feature [331]..[331]: n is a, t, c or g
tctaatgttttgtaaccaaagtggaagaacgtcaaattcaataaagaaaacaaaatatttattaagtaaacaacaaggaactgtgggagagtgtaacttggagattccaaagggctctatccctgatgatctggttatctgatttatgtcagcttgtaattgtccttgttttgacccaagagatgattgtgtgggaagtttgtctctgagagctaatgcatggctctgcagtgtgtctggagtgtatgaagagtgccacctctccaccccttctaaagagagaaggacttatcttctctagctggaaagtgacattctttgctgaccaccngtcaggaactctgtgcagggacaagggtatgagaccactctccccactgtgcttttattgactatgcaagttgagcttgactctttaaagggaagaatactcttccagtcaaagccttgatagaacaaccagtttctctaattgggttttgttgcaaaagaaaaatagattcttactgcactgatgcaaacaactatattgccacaagttaagaacactcacagatagtttctgaattctagaggaaacaggcagagagaaacaaacatgctccacattttgttcacagaagtataccttactcaattattaaaggctgtaaatagttca

SEQ ID NO: 194 - DNA, 661 bp, Homo sapiens
  misc_feature [331]..[331]: Chromosome 1, SNP identification no. = rs1286560
  misc_feature [331]..[331]: allele = c, in linkage disequilibrium with rs360659, respectively
  misc_feature [331]..[331]: n is a, t, c or g
agcctatactagacaacgactgtgtaaaccacggtgcactgaacctatgtaaggggtcaccattctgtggagatacggaacggaagaagtagacctctgtaaattgggggtatgtgacaaaagaagaggggaaagggagaggacgaatgtttaattgtgggtcttaacatggagagtcggtgtcaccagacgaggggcacgactagagagtcaagtgggaccgagtatccccacccttccttgaaccccaggtgtggctcatcttgactccgtgattaccgggaagacctgtcctttgagagttctcactctcccgatttcggattttggnccgttacagaccccaaagaagacggaaaagttgattttagtcgagaaaggttcttgggtatgacggataagaggataaaagagacacacaaaagtctttactggaatgtgtgggtggtctggtaggtggtgtccccgttcaaacggagaaaacgaaagtgaaacgtacggtgtaccgaagaatttgtgtgtgagggacaataaacacaaggcgtcgagaatgacacaaatacaccgtcgtttctgtgtccgagggaatgtctataggggactctaaatatgaacaaaaatgtgatgatcgaacgtactggaggtttggaaggggacagac

SEQ ID NO: 195 - DNA, 661 bp, Homo sapiens
  misc_feature [331]..[331]: Chromosome 1, SNP identification no. = rs869990
  misc_feature [331]..[331]: allele = a, in linkage disequilibrium with rs360659, respectively
  misc_feature [331]..[331]: n is a, t, c or g
agatcaaaaattttgtactttttcttgtttaccatttttcagttttaaaggattatcaaaagtttaaagtttcacaaattagagttgttcgtttcaatcaagttgtataggtgatgtagggtcttcgaaagacaggtcgtactacctgtctgtcatttgttgactatgtactatttacgatgttagggtctccatacgtctccaacgagtcctcgatattctttcccattagtaacgagtatcgaatgtatcgttaggtaagagggagttcactttttattatacaagatctcaaaccttgtcttcttccaaaaggggtggaagacgtaangggaacacctatgttaatcaaagtcacataaggccagttcttgttatacttaattatttaataaagtgatggagcgttttttttagtttgattttatgtgaaaatggtcaatagacgaataaagtttgttttctttttaaaacagacttgagaagtaaacgatatagagttacgggaagtaacggtaaacatcggtctaaatttaatgatcaaagaaaaattaaaacaacaaatagactcatttaaatggattaagtgtcccagtgacattcttactttactttatatcagtacgtgacgtatttctgtaaacccatttattacctggtg

SEQ ID NO: 196 - DNA, 661 bp, Homo sapiens
  misc_feature [331]..[331]: Chromosome 1, SNP identification no. = rs360599
  misc_feature [331]..[331]: allele = t, in linkage disequilibrium with rs360659, respectively
  misc_feature [331]..[331]: n is a, t, c or g
ttttgttttttttctacctcagctcctgatatactttttatgtgattggtatgttttaaacacttatgaaaaaatgacgaacataataaatgataaagattagtatttggttagttttagtagttgtttacaacaactgttgctcttcaggtagaagttctagttgaagattcaaagatgtgtaaaggtggcaagtcaaaaataaaaattgttcactttataaagagtgtccactgccttgtcttgattataagaaaaaaattgactgagctgattttgaacaccacaagatactctcttgaccgtatgatgtaaaaatcaaagataaaancctgtagctaaggtagttcaactgctttatgagttgatattttatgttgtttccaaaatataattcatgtgaaaattgttctaatattaaacagtctaaatttataatttggagatttaaaattaatgtataatttatgtctaggatcactgtgtacttttaagtaggcaagatagttgtggaatgaaaaggagaaagtaatgtagtaaatgtaattgctatgtacatacttgcccaaaagaaggattctttgtaaaaagacaagtctatgatgatatatgtatatatacatgtacaatataagagaattttaatcctatcatgttatct

SEQ ID NO: 197 - DNA, 661 bp, Homo sapiens
  misc_feature [331]..[331]: Chromosome 1, SNP identification no. = rs360603
  misc_feature [331]..[331]: allele = g, in linkage disequilibrium with rs360659, respectively
  misc_feature [331]..[331]: n is a, t, c or g
atctaaatattaaaaaatactgctcagagagtagaattcagataaaagaggctaggaagagtagtgtggtgagaggagtaaggatggttaatgggtacaaaaatatagttagaattaataagatctagtatttgatatcacaacatgttgattacagtcaacaataatttattgtacatttaaaaataactaaaagaggctagtgcagtggctcacacctgtaattccagcattttgggagggcccaggcaggagaattacttgagcccaggagtttgagacaagtctggtcaacacagcaagaccccatttcatcaaaaaattaaaaaantctcaggcctggtggtgtgtgcctgtggtcccagctactcagaaggctgaggctagaggattgcttgagcccaggagttccaggttgcagtgagctgtgatcacaccactgcactctagggcgacagagtgagaactttgtctctaaacaacaacaacaaaaacccccacaaaactataactggaatatttgtaacacaaagaaatgataaatgcttgaggtgatggatacccattttccctgatgtgattattacacattgtatacctgtattgaaatatcttatgtaccccataaatatatatacctgcaatatacccataagaatta

SEQ ID NO: 198 - DNA, 661 bp, Homo sapiens
  misc_feature [331]..[331]: Chromosome 1, SNP identification no. = rs360606
  misc_feature [331]..[331]: allele = t, in linkage disequilibrium with rs360659, respectively
  misc_feature [331]..[331]: n is a, t, c or g
taaaaatctgtattacatttggcaatgaaatgatgaggtttgtggttactaaattattaattacagccaaatgtaccaattttgttttatcacaatttccttctctacaggagcattcctttaagcttatatacatgctataattttttgcaacttaaaaaaacgctttcttgacctcatatccactttcacctactcttatttctctgttccactttacagaaaaaaatttctttagagggttgtgtatactcccttctccattccttttgttaactcctaaaccctctacagtaagattatgtcctctcctctccacatcaccataacnagtcaatatctttgggatcttggcattgctgattccagtggtcaattcctagtcttcagcttacttgacccatgagctacatttgacagatcacgtcccctctcttagaacactttcatcacttggcttcagttgatcacttcttccttcttgacatgcatgtttttttcttgatttccaagaccccacacactcttgatttttctccttagtggttgcactttcagtttattttgttaattcctcttcatctcccacagagacaaatgacaagaatattccagggctcagttctcttttttctgtactcactttctttgcaatttcatc

SEQ ID NO: 199 - DNA, 661 bp, Homo sapiens
  misc_feature [331]..[331]: Chromosome 1, SNP identification no. = rs360607
  misc_feature [331]..[331]: allele = a, in linkage disequilibrium with rs360659, respectively
  misc_feature [331]..[331]: n is a, t, c or g
tctgtactcactttctttgcaatttcatcctatctcatggctttaaaggccatgtatatgctgaccactcctaaatttattatatataccaacctggagtgctctcccaaaccccattaaatagcctattcaagattttaacttggatatctagtaggcatatcaaatttaacacgcttgaaagtgaattcctagttgcctccccctccatccttctatatttgttctccatctctgctaaatggtattttccatccttgaagttgtataagctaaaattttttgtcatccttaacttctttctttctcttatacccatatcaaatatacnacaaatcccactggctctgctctcaaaatatatccagaacttaaccagaacttactatttctatctttaccatcctaatttaaactactctcctaactggctttttctgtttctgcccttgcctctctacagtctattctctatacaggagccagagtaattctttgaaaatgtaagtcagatcatgtgatacccctcagctcataacccttaaatggcttcctattttacacagattaaagccaaagttcttttcatcattgcctattactattccttttgcttattccattccagccatgctgcttttgacgcagatattcctaaaaa

SEQ ID NO: 200 - DNA, 661 bp, Homo sapiens
  SYCP1
  misc_feature [331]..[331]: Chromosome 1, SNP identification no. = rs360614
  misc_feature [331]..[331]: allele = g, in linkage disequilibrium with rs360659, respectively
  misc_feature [331]..[331]: n is a, t, c or g
tttatgtcttcgtctttttttccaaaatttcctatatagaattttgcaattagtttattattaggaaaacttcgaagttttctttatatgtatatccattattcaatataaggttaatgttctttaaattatacttaccctttagaagactggaggtttagtctcagaaaatcaggaaggactatcactgtcagtcttaatggttggatttttctatctacaaagatattcttttatgaagactattctcgaagatttattattgttaatttatgtcttctgatcattacgttattgatttctgaaaaaagcagaagtttattcgtcaagnaatggatttgtctaatatagatgtacatgatacgaattgactggacgagttcgtgcccgttctttaattgaaaaacatttcgtcctagacgttctattttctgttgtccataatttatgcggttgtagaaaaagagaaagaaaaaaaaaaagaaaaaagagaaaaaaaaaaaaaaaaaaaaactctctctctcctgtagaccgtgataacggatctgatctcccgtcactgggtagtaccgagtgacgtcggagtttcggaggtagagatcccgagtttactaggagggtggaatcggagggttcatcgaccctgacgtccgcgtacggt

SEQ ID NO: 201 - DNA, 661 bp, Homo sapiens
  SYCP1
  misc_feature [331]..[331]: Chromosome 1, SNP identification no. = rs360617
  misc_feature [331]..[331]: allele = a, in linkage disequilibrium with rs360659, respectively
  misc_feature [331]..[331]: n is a, t, c or g
tttttttttcttatttttttggattgtcagttacaatctttattgctgttattattattattttatgggttgtaaataactcgtgaaacgtaacaagattcgtataaataattgtaaattaaaagtcctgttatgattctccgtaaattaattatttgtctcactgtctgtctgatgtattaaatgagtttaataagttcgagggatccacctgtctttgactttcagatttaaactcgtggccgatagattaggaattcgggttcgacaattcatcattcgacatactatgtttaattttaaaaatcgattctttttatctcttataggnctttttcgtccatctgtcataaagggttacctaagaaccgtctttgtttcatttcggtcccagtttaataccgtttttatttcttaatataaaatattagtgtgtgaataaaaagtagttttacccttttttaggatgaaatattaaatttttttacttttgtacgaaattttaaaaatttgacaagaaagtgtatgtgttgtgttggtataatcttataaaattttcttaaaaagaaatcctttttaaactcttaagataaatctaacttttatttgtaacgtggtgataagtatttatgttaccgaaatcgtttcggagatgaccata

SEQ ID NO: 202 - DNA, 661 bp, Homo sapiens
  SYCP1
  misc_feature [331]..[331]: Chromosome 1, SNP identification no. = rs360622
  misc_feature [331]..[331]: allele = c, in linkage disequilibrium with rs360659, respectively
  misc_feature [331]..[331]: n is a, t, c or g
gcacatgtatcccagaacttaaaaaaaaaaaaagagtatacagtctagtgaggggagaggatacagatcattaatgaataaataaaatatatgttaggtgataactgcttaaggagagaatattttgggacagggtgattgggaagttttttctggttaagtgacattgggtagagacctgaataagggagtgggccatctattttaggaaagaatatttcaggcagaggaagcagttaagtgcaaagtcccagagatgagagcctgttcaatcttttcaggtcacaataatgaggccactgttctgtatttctgactctgtatttttcancttttttctcactgtactccactcaggatacttttttctttctttcttttctttttttgatggggggtggggtggtctcacactgttgcccaggctggagtgcagtggttccatcttggctcaccataacccccgcatcccaagctcaagcaatcttcctacctcagtttcccaagtagctgggactacagctgcacaccaccagggctgtctaatttttgtatttttttagagacagggtttcgccatgttgcccaggatagtctcaaactcctgggctcaagtgatcttcccaccttggcctcccaaaatgttgggattataggtgtc

SEQ ID NO: 203 - DNA, 661 bp, Homo sapiens
  SYCP1
  misc_feature [331]..[331]: Chromosome 1, SNP identification no. = rs360627
  misc_feature [331]..[331]: allele = g, in linkage disequilibrium with rs360659, respectively
  misc_feature [331]..[331]: n is a, t, c or g
gccttgaaatcctgggctcaagcgatcttcttacctcagcctcttgagtagtggggactataggtgtgtatcaccactcctggctaatttttctattttttgtagagaaggggtttgctacgttgcctagggtggtctcgaactcttgggctcaagtgatcctccatcctcatcctctcaaagtactgggattacgggcatgagccactgtgcccagctctaaaagcattttgaaatggccctctttatatctgacaactttccttgctttgaagttggctgtgtctgaaattaatatagctactctttttatatgattatttgccatccntatgtctccttttgtaaggtgtctgttaaggtctttggcccattttttaatcaaattgcttgttttcttaatgttgaattttaatcaacaataagagaaaagacttaataatatttgagtctttgtatattatagataacagtccttcatcagatgtttcttttgcagacattttctcccagtctgtggcttgtattctcattctcttgacattctcttttgtagagtagaagtttttaattttcttttgattagtgttaacatgctttcttgtgattagtgttaatatggtgtatctttatccatttacttttattctagatgtgattt

SEQ ID NO: 204 - DNA, 661 bp, Homo sapiens
  SYCP1
  misc_feature [331]..[331]: Chromosome 1, SNP identification no. = rs360630
  misc_feature [331]..[331]: allele = t, in linkage disequilibrium with rs360659, respectively
  misc_feature [331]..[331]: n is a, t, c or g
gagattttttttattttgcttctttactccccgaataatcatctgatctgtgtcgactcctttcattagaaacttcaacttctataaagttgtctttggagtttttgactttccgtttctcttttttctgatctttcttgtcttgtcttataggttcttgacactctgttgatgtttttcatattacccttatggtcttcctcttctttctctttttccttgtattttataaacattgttattactgattcttaaaagggatttaattaaagtctgtggttcagtgtctaggtctttcgagtctcttgtctttcgtcctatttacggtttntgtgatgtggatacgtataatgtaagtttgatgttttttagtttctatttcgatctcctttttttgtaaaatggatgtctcctcgtttttctttctaagatagactgaggaggagtctttggtgcgtccgttcttatcttacctcattttataaattttacgactctcttttttggtcgttgtgtcttaagacattaaactctttgataggaagttttcacttctttatttatgaaagaaactgttttcaactgtcttacacaacggtcgtctggacggaaggttctttacaattttctttaataaatttctctttcttttactaaatac

SEQ ID NO: 205 - DNA, 661 bp, Homo sapiens
  SYCP1
  misc_feature [331]..[331]: Chromosome 1, SNP identification no. = rs360634
  misc_feature [331]..[331]: allele = c, in linkage disequilibrium with rs360659, respectively
  misc_feature [331]..[331]: n is a, t, c or g
gttttgaaatgtgctattcataatatcaatgaagaggaactaaaatattctgttgcatctttcttttttcttttttagcctaagaaaacaagacacagatgttttttatattcatgtcatatagtggaagacttgaaaatgttaactctatatcctttggcattcacaagaatgtttcagattattattatgccatctctatcagtttcaagtcttctgcttcccaaatggaaagcaatatatataatagaatcctcttctatttctcactatatttgcagtttttcttgtctgatttgccacaagatatcttctaatatggttaacaagnatatctacttaataatttaaaaaattaattcacagtacagagaggataataaaaaccacaaaaatagagtgaagtactgaaacgctttttggagttctaggtgcatgggcagagcttacagattgttgggcttccttgtaaaatgatggcatggccagctagtgtttttgctgaggactcctaaatgtcattatttgtaacactttttttgctgggggtttctaaattcttgcttgtggatataaacttggctgatggcattctggagctgaattgggcaggatagcaaagacagactgaatcttaccattatgtatgttgacttttcca

SEQ ID NO: 206 - DNA, 661 bp, Homo sapiens
  SYCP1
  misc_feature [331]..[331]: Chromosome 1, SNP identification no. = rs360635
  misc_feature [331]..[331]: allele = c, in linkage disequilibrium with rs360659, respectively
  misc_feature [331]..[331]: n is a, t, c or g
atataatagaatatatttgagaatgaacagaaaaggagattaactaattgaaatagagacctaaggagatcgtctttacaatttagaaagtaaaataaaagaaagagtcactaaacctagttatcatcactatggattttataaatttattatgtaatagttatacttttaaatttatactgtggaattgtaaatattatggatgttaataaaatacatgaacagatgtacgaaaagtcgaccaggtgaattgggagggtgggaccagagatgagggaccgtcggttacatcagtctcttgaccgggataatagaaacattctctgtcacngtatagtttaactttttccgttagagatttgtagccataaggtccgtgtccctacccacccccatatatattaccttttcagttgtatgtattaccattctaagtcagacagaaacgataggacgggttaagtcgaggtcttacggtagtcggttcaaatataggtgttcgttcttaaatctttgggggtcgtttttttcacaatgtttattactgtaaatcctcaggagtcgtttttgtgatcgaccggtacggtagtaaaatgttccttcgggttgttagacattcgagacgggtacgtggatcttgaggtttttcgcaaagtcatga

SEQ ID NO: 207 - DNA, 661 bp, Homo sapiens
  SYCP1
  misc_feature [331]..[331]: Chromosome 1, SNP identification no. = rs360636
  misc_feature [331]..[331]: allele = c, in linkage disequilibrium with rs360659, respectively
  misc_feature [331]..[331]: n is a, t, c or g
ggttctaacacggtgacgtgaggtcggacccactatgtcactctgaggtagagttttttgtttttattataataattaaaactcacggaatatacacggtccgtaacaagagccgtgaaccttacgttgtcaaggttcagtcacttgttttttctgttccagagacagagacacctcgtatatcaactttgtaaactttttccattctcgtacctttttccttttcttctcatgtacataaaatgttttcgaggggtccaattagataatacgggaggaggttggcttggttgagtctaactcttcatgtcatgatctttcgtaatgttgnttgaacattactttcagttacaaatcttgtattgttctccttatgtattccgtgtaatataatagaatatatttgagaatgaacagaaaaggagattaactaattgaaatagagacctaaggagatcgtctttacaatttagaaagtaaaataaaagaaagagtcactaaacctagttatcatcactatggattttataaatttattatgtaatagttatacttttaaatttatactgtggaattgtaaatattatggatgttaataaaatacatgaacagatgtacgaaaagtcgaccaggtgaattgggagggtgggaccagagatga

SEQ ID NO: 208 - DNA, 661 bp, Homo sapiens
  SYCP1
  misc_feature [331]..[331]: Chromosome 1, SNP identification no. = rs360643
  misc_feature [331]..[331]: allele = t, in linkage disequilibrium with rs360659, respectively
  misc_feature [331]..[331]: n is a, t, c or g
tgtcacagattagatattagttatttactattgacgataattctactactattaccactatataccatctttgacttgtgattataagtactattaaatgttatataaccagtccgtccgtttatttgttactaacacgactacccatgagtgaccttcaagaccctcaaatggatctcccctgtggattcggtttattctagtcagttccaatctccatgtccctctgtctttttcaaatttctgaagttctttcatcgtcgactcaactttgtaaactttctgtcattcttaatttaatcgtttccattaccttcaatcctctcttttncagtgcccgttcacattctcgtgtatgtttccttttgtgtcttctctatcttactgtgcaagaccgtagatctcttttacataaaatcctcgtattccgaacttcatattgcttattcagtgtcctctatactaacctttgcattgttcctgttctagtattgtcctgaatatattgaacgagtctcagaagaccaagtattaagtacttctggtacgttttgttatttcctacaattcgttgtcttcatgcacggttcaaatataaaaattttaaggtaagacttttttgatgtatcttactttcccagtaaccaggctgacacccctt

SEQ ID NO: 209 - DNA, 661 bp, Homo sapiens
  SYCP1
  misc_feature [331]..[331]: Chromosome 1, SNP identification no. = rs360645
  misc_feature [331]..[331]: allele = c, in linkage disequilibrium with rs360659, respectively
  misc_feature [331]..[331]: n is a, t, c or g
tcagatatacaaaatataaacacgtgagtaaaaatttgtagtattttcgttatcctcttttttcttcaagtaatataagagacttaagtttaatatgctaaaggaaaatgattcgatggaccggagcccgtactatgaattggtcagactgatgaaaagggtggaccgtacaatcttattactattaataagtataatacttctcagtggacgacaatcttaatttgttctattacgttgaattttacgaattcgtgtcacagattagatattagttatttactattgacgataattctactactattaccactatataccatctttgacntgtgattataagtactattaaatgttatataaccagtccgtccgtttatttgttactaacacgactacccatgagtgaccttcaagaccctcaaatggatctcccctgtggattcggtttattctagtcagttccaatctccatgtccctctgtctttttcaaatttctgaagttctttcatcgtcgactcaactttgtaaactttctgtcattcttaatttaatcgtttccattaccttcaatcctctcttttccagtgcccgttcacattctcgtgtatgtttccttttgtgtcttctctatcttactgtgcaagaccgtagatctct

SEQ ID NO: 210 - DNA, 661 bp, Homo sapiens
  SYCP1
  misc_feature [331]..[331]: Chromosome 1, SNP identification no. = rs360647
  misc_feature [331]..[331]: allele = t, in linkage disequilibrium with rs360659, respectively
  misc_feature [331]..[331]: n is a, t, c or g
tataattaattatcattaacttattaaataaatggtttcacaaatgtgattacataaaaaataaactagtattttcatttcatctaaatagcagtttttctaatgcttgagtgttaaagactctattttttactactctatattaaggaaatatttatataaagctgtgttaggaggcctagataattattttttgtctcattagcattagggttaattaagtttggtaggataaaggagaacaggtttctctctgaagccatagccggggcctagcaatagtttttctctgttgcttgtgcatggtgagggaaaagctagcctttctagntcccctaatttatatatttttgattgacctatccagtgatttttcatttttaaaaaggtaggttacctaagattcctctatccctattacctcagttttatactttgaggaaacagaaagccagagaagttaaccaaattatacatgttctcataattatattgttcctaaggcagaattcagtataatagtagttacatactcaatttctttcagagttctaggatgcgttaatctgattatcatcaacagctaagagaaaacttataccataagctttaaggtatatctatgtatattacataaatgtaatatagaattatgtattta

SEQ ID NO: 211 - DNA, 661 bp, Homo sapiens
  SYCP1
  misc_feature [331]..[331]: Chromosome 1, SNP identification no. = rs360655
  misc_feature [331]..[331]: allele = c, in linkage disequilibrium with rs360659, respectively
  misc_feature [331]..[331]: n is a, t, c or g
acgctttttctgtgtcaatttatatgatcatgtggtttttcttctttagaccattaatgtggtgtattcattgatttacaaatattgaatgaaccttgcatttccaggataaaccccatttggtgttgagtattgtactttttttctatttcactgaattttatttgttaatattttgctgaggatttttatatttgagttcataagagatattggtctgtagatttcttttcttttgctatctgtgtctggttttggagacaaagtaatgctggctttgtaaaatgaactgagaagctgtttcacagaggcaggtctttgcaaacctatnccaaagttcaaagaagcttagaggctgaagaaagaggcttataaatccagtttcttggaaacatttaatagggacttacaaacagaagccatgtgtgtctcaagtagtggtaagacaagatgatgaatccctgcatcgttaacccccagacccaaggattatataccttagaggaggggtacatgtgcttcagaggcaatactagaaatatgtcctaagggcaggatttacgggaagtaccttcttgtacacaaggaacaatagataaactggaaatcttagaggactttctggaacaggggttaagcagaagccaacatggtagattag

SEQ ID NO: 212 - DNA, 661 bp, Homo sapiens
  SYCP1
  misc_feature [331]..[331]: Chromosome 1, SNP identification no. = rs360659
  misc_feature [331]..[331]: allele = a, g
  misc_feature [331]..[331]: n is a, t, c or g
atatttaatatttatttgaatggatttgaaattgtattttactcttaaggatctaaataatgtgctaatttcattgctaaagaaagtacatatcactgacataaagaaagagtacatcccaaatttgagaaccactttagatcaatgtgttacttttcttagaggtatttagttccccataaaaataatcattttcagttctaactggttgttttggttgttttgctaaattattttataggtttttgctgataaagtgtcaaaataaaaaattatttcttacattatccaaataaaatattgaattggatgattttacctactcagtaantttaatttggagagaaagcggggaaattattattgtattattactcagagaaaagtaaattcaagtagccagtatagtggtggtgagcatgattttccccttttggtggcttctcagtgctagattaaatatgagaagtaaacagtttatgcagcatcctctcccttcctttttatctaattctctatttctggtaccttttcaatagtacttttttaagggccctaggttaaactcatctattaactaatgtcccttttaatgaatggactggttagttatttgtactttaatgtaaatttgttatccttagtatatttgcttttcaac

SEQ ID NO: 213 - DNA, 661 bp, Homo sapiens
  SYCP1
  misc_feature [331]..[331]: Chromosome 1, SNP identification no. = rs360661
  misc_feature [331]..[331]: allele = a, in linkage disequilibrium with rs360659, respectively
  misc_feature [331]..[331]: n is a, t, c or g
attactgtattataccttaaaataagttgtattactatcccctttccctacttcccgaccccctttttgtactttgttttaactgataaccaaatattaaggacttcgacccactatccaactagtaatgtaataaggaagattaaaaatataaaaactttaaaaagaaatgatttaaaagtttacagtatgttatataaaggaacgtacaagggacaaacgagtaggaaagtatgaaaggtgtttaaaacttctcgtgtaataaaagaagttattaaaaaaggagaggtaatctgacagagaatcttcaataaagtttgaaggatattgnactaatttcatcatgtgcttcgtaatcgacacaaattaattctataaaaatggacgtgcaacacgtgtacatgggattttgaatttcataaattttttttttgacttaaattgaaaaaacgtgttgtggattgaacgagaattttctagagtttacaagatgaaaccttctctctaataacgacataacgaatgtaggttatagttaaaatttacttccgcctcctcatacaccgagatgtctcactaaaatcctcgtagataatagataaagatgaattactatgacctttaagtagtttctcctctatttcacaaagtgattcggtta

SEQ ID NO: 214 - DNA, 661 bp, Homo sapiens
  SYCP1
  misc_feature [331]..[331]: Chromosome 1, SNP identification no. = rs360576
  misc_feature [331]..[331]: allele = t, in linkage disequilibrium with rs360659, respectively
  misc_feature [331]..[331]: n is a, t, c or g
agtcattcaagtggatgtaatgacattattttagtcatttttacttttggatatttatgttttttagtttttcattttcatagataatactagtaaacatgttggcacataaatactttttccttattttgaattggatcatagtaataatgatttctatggcttgatggttagtttccaataggttgtatcattgtaaaccatgcaatacaacaaatattatatgaaaatgctggtcctaaaatgttttaattgatattgggtattattaatttattgataatttaaaagataaggataagtcatttttggtatgatttgtgatttttantttttggataagctttggaagctttcaagtttgattttagaatttcttctttttaaaattgtctgcttatacctgttgccctctaatcttttgaggttttttttttttattgatttgcttaagcttctaaaaatatattaatcttttacctggtttatttatagcacatattttccctaacctgttgttttcctttaacttcagagaactttttattatatgaaaggtttcaattttttattaaacttgattgtcttttgtgattttaccattgcttcttttaaggtttctttttaattttcgatttttaatttttgtgggtgcatagta

SEQ ID NO: 215 - DNA, 661 bp, Homo sapiens
  SYCP1
  misc_feature [331]..[331]: Chromosome 1, SNP identification no. = rs360586
  misc_feature [331]..[331]: allele = g, in linkage disequilibrium with rs360659, respectively
  misc_feature [331]..[331]: n is a, t, c or g
tgtgaagccttagattaatagggattagtggaggacaggtggtggatacaagtatagcagggaggataatattctaagttaaaaaaacataaacattatatgggtaagcctgaaagtatcagagcatggcatatttaagtaactacaaaaaattcattgtaactaaaagatggagtttaaggtagtggtggtagagggcagagtgaggaaagatgagggtagggagaggtaagcatggagagatgaaggtggggaaaaatgagggtggatcatttaaggccacctaagctacatttaagagtttgaggtcattgaagaattttgacatgangattgttaaaattatatttacacttttgagagctgtaaaactattggaatagttcaaggatgaaataaggtaccattttaaagggcttacaatagaccaggtgcattctaggttctttctatgtattatcttacttaactagaagtcattattgctcttattttataaattgggaaatcagacctccaaaggataaaaaccttcaaaaggttacatgactaagaggtagtagaggtggtcttctacattctttaaattataacacattttcctccctgaaaagctatttttcctttagttcatatttattagttaaattcaacctgaaaa

SEQ ID NO: 216 - DNA, 661 bp, Homo sapiens
  SYCP1
  misc_feature [331]..[331]: Chromosome 1, SNP identification no. = rs360588
  misc_feature [331]..[331]: allele = t, in linkage disequilibrium with rs360659, respectively
  misc_feature [331]..[331]: n is a, t, c or g
gatttaaggaaaaaaattaaatgcatgacaaatttttagcatatttcagttttccatatttggatttcaacttacctgttaaaacagtttcccagaaagaatccaggttgtaaatatttcccagatattttgtgtgacattgaatttcattacacttttcttcccccaatctgctaccttagttcagacattttttattttatatatattttatctatctgagccttagtttcctcatctctcaaatggagataataccgatcctttctatctcattggattgttgcaaagttcagaattaataaatgtttgtgaaagctatatttagggnattataaacatttatgtacaagacaatttaaaaaattcgagataaactgggaaagctgataaaacattgcaaagataagaatgatgaatgttgacatataagtaacatgaaaatgatttttttaactgagagaaattatatatattaatggtatacaaagtgatgttttgatatatgtatacattgtgaaatgattaaatcatgctagttaacatattcatcacttcacatacaaagataattttttttttaaaaaaagagatactgaggctgagtatagtggctcacacctgtaatcccagcactttgggaggctggggtgagaggatc

SEQ ID NO: 217 - DNA, 661 bp, Homo sapiens
  SYCP1
  misc_feature [331]..[331]: Chromosome 1, SNP identification no. = rs360590
  misc_feature [331]..[331]: allele = a, in linkage disequilibrium with rs360659, respectively
  misc_feature [331]..[331]: n is a, t, c or g
acaggagtatgccatcacatccagctaatttttgtatttttggtagagatggggttttgccatgtttcccaggctgatctggaactcctaggctcaagtgatccacctgcctcagcctcccaaattgctaggattacaggtgtgagtgactgtgcctgacctgggcagaaaaaattaattgagaaatttctcaaaaatttatcacacttaaaacaaacttgcagatccatggccctcagcaaatccaaagcaagataggcacaaaaccatatgtaggcagtcatatcttagtcaaagtgctaaaaccaaagataaaaagaaacttttaaangcagacagaaaaaaatgtcacattgcacaacagtgacacagatgatggctgaccttgtatcaggacagtgaaggtcagatgacaaaggaatgacatttataaaatgctaacaaaaataaaccatcaacccagaattctgtatgcagcaaaaagctttattaaatgaagacaacatgacttcaaaagctgtaccctaagcaatacttaaggaatttcttcaagttgaaggaaaatggcattagatggaaactgatcaatgaaaagcactggaaatagtaaatattgagatgaatttaaaaggcgatatatttttcttttaattttaaaacg

SEQ ID NO: 218 - DNA, 661 bp, Homo sapiens
  SYCP1
  misc_feature [331]..[331]: Chromosome 1, SNP identification no. = rs360591
  misc_feature [331]..[331]: allele = t, in linkage disequilibrium with rs360659, respectively
  misc_feature [331]..[331]: n is a, t, c or g
aggcagacagaaaaaaatgtcacattgcacaacagtgacacagatgatggctgaccttgtatcaggacagtgaaggtcagatgacaaaggaatgacatttataaaatgctaacaaaaataaaccatcaacccagaattctgtatgcagcaaaaagctttattaaatgaagacaacatgacttcaaaagctgtaccctaagcaatacttaaggaatttcttcaagttgaaggaaaatggcattagatggaaactgatcaatgaaaagcactggaaatagtaaatattgagatgaatttaaaaggcgatatatttttcttttaattttaaaanggtatatatggctgcttaaaggaaaacaaattgctattatagagtttataatctgtgtgactaccataacacaaaggacaggggagtaaatataactattttgttgtagcatttttacattacatgtgaaatagtacaatattaacacttaaatagagtttggtaagttagtgatacatactatcctccttagagcaacccctacaaaataatgcaactgaagtatagctgtcttagtttaggtttctaaaacaaaataccacagactgggtggcatataaacaatgaacatttatttcttacagtactggagactgggaattaaaaaat

SEQ ID NO: 219 - DNA, 661 bp, Homo sapiens
  SYCP1
  misc_feature [331]..[331]: Chromosome 1, SNP identification no. = rs360596
  misc_feature [331]..[331]: allele = a, in linkage disequilibrium with rs360659, respectively
  misc_feature [331]..[331]: n is a, t, c or g
tgtcattaaaatatctcctagagaaaaatccagatctggatgatttcactggtaaattctgtcaaacactttaggaagaaataataccagtcttccacaaaaaatagaagagtgaaaacaattctcaagtaggtttttgataccaaatcctaacaaagacattataataaaagaaaattacagaccaatatccatctgaataaaagaaaattacaggccaatatccctatgaatatgagtataaatataaaattattaataaagtattagtaaatctaatctagattttaatacatgataaaaaccatattacatcaaacaatttatcagnaatgggatttatcagaaatgtaaggttggtttaaaatttgaagctatcagtgtaatttactgtaccaagtaataaaggagaaaaataatataattatctcaatagttgcagaaaggcatttgacagaattgaacacttattcatgattaaaaaaaaaacttccagcaaactaggaatagataaggacttctccaatctgataaagaacatctacaaaatacctacagttagcatcctatttactgatgaaaggcagtgtcaagagcaatgtctgctcttaccacacctattcaacattgtactggaggctctggcaacaaaaataaatat

SEQ ID NO: 220 - DNA, 661 bp, Homo sapiens
  SYCP1
  misc_feature [331]..[331]: Chromosome 1, SNP identification no. = rs360668
  misc_feature [331]..[331]: allele = a, in linkage disequilibrium with rs360659, respectively
  misc_feature [331]..[331]: n is a, t, c or g
ttctggaaccatttgtttagaactggtattattttttcctcaatagctttgtaggattcatccataaattcatcttggcctggaaaaaaaaataaagtatgggcaaaggacttgaatagatatttctccaaatatacacaaatggccaataagcacataaaaatgaaaatatgcttaatatcagtaatcattgcaaatcaaaatctcatgagatattacctcatacccattagaatgggtactaatgaaagaacagaaaataacatgttaatgaggttgtggagaaattggaattctcgagcactgttgatgggaatgtcagatggtacantcactgtggagaacaattttgtggttccccaaaaaaataaaactaaaataactatatgatccactaatttcacttctagatatatacctaaaagaattgaaagcatagtctcaaagagatatatgttcacctatgttcatagcaacattattcacaatagccaaaagttggaagcaacccatgtgtccattgacagatgaatgggtagactaaatgtggcctctacatacagtattccatacagtatggaaaatgttttggtggtttcttctaaaactaaacatgcatctactgtgtgatccaacaattattttcctagatatttactta

SEQ ID NO: 221 - DNA, 661 bp, Homo sapiens
  SYCP1
  misc_feature [331]..[331]: Chromosome 1, SNP identification no. = rs506934
  misc_feature [331]..[331]: allele = a, in linkage disequilibrium with rs360659, respectively
  misc_feature [331]..[331]: n is a, t, c or g
aaacctttgtaacttaaaattgtaaatttttaaacggtctttgtggtcccgaagatgttttgactgactaaagtttagaccctgtcctttatgttcggaatttgatcgtaatcctctatatggattacatttactactcaattacccacgtcgtgtggttgtaccgtgtacatatgtatacactgtttggacgtacaacacgtgtacatgggatcttgaatttcatattatttttttaataatgtagtttttttcttcggaatttgtaaaacagtattgagtttctttcaatagtctcttttaatgtcaattcagttttcctgaacggtgngtcgaatttctccgaggacgatcggtttccacccttttacactcaatagttattcctgtctacgacgtgacctaactttgtatggtttacacaagtttagatactcaagtgttacaataaatttaataaaaaatttaggagtggtgaagggagtattattagagcataaggtcgtcgaaaaaaaaaattaacttatccatccatatgggatggagaagaggtttagaattccccttactccgaattaaggaattgtttacctatgagattttgttgttaatttttatattctgtttttgtgtagtttgtgattcataaagtagataaata

SEQ ID NO: 222 - DNA, 661 bp, Homo sapiens
  SYCP1
  misc_feature [331]..[331]: Chromosome 1, SNP identification no. = rs360675
  misc_feature [331]..[331]: allele = c, in linkage disequilibrium with rs360659, respectively
  misc_feature [331]..[331]: n is a, t, c or g
ttacatatgtatacatgtgacatgttggtgtgctgcacccattaactcgtcgtttaacgttaggtatatctcctaatgctatccctaccccctggaacacttttaaatatactgtatatgagtaatattatctcgtattaaaatgcttatatatttagatatgctttttttgaagctattcatcatgtttcagaaaaaaaggctatctctgtagtgttttacagtttgcaaggtgaattgattcaccctataaatgacaaatactattttttttggtttctatgagatgggaactgtgtttagtaccctacttacatttaatttaatcttnacagcaatgttatatcccacaatttattattatctttactttgacagaggttacattatttattcaggattacgtagtaagagagcagaatgactagatttcaaacctaggtctatttttgcatggcttcaaacctattctcttaatcactctgcaacagcttaggtaacatacactttcaatttcaagcctctgagaatttgtttactttgtttcctgcatttaattcctttcatccttttctatcttggaaaatctcacacatctttcatcttatagttgtgagcttactatatatgtgtgtattctcatagcactttgtttttaatg

SEQ ID NO: 223 - DNA, 661 bp, Homo sapiens
  SYCP1
  misc_feature [331]..[331]: Chromosome 1, SNP identification no. = rs360682
  misc_feature [331]..[331]: allele = t, in linkage disequilibrium with rs360659, respectively
  misc_feature [331]..[331]: n is a, t, c or g
atgaggtgcaatctgacatgttgatatacgtacgtgtacgttatagaagattcaatcaaactaattaacatgtctatgaccttgccaacttatcatttttttgacgtgagaacattaaaaatcttttagcaattttaaaatatgcaatatcttattattagtggtggtcatcatgcagtgcaatagattgtgtttttaattttgtttcctatatgcttatcattagtgtacagaaacatgattgatttttgtgtttattttgtatcctgtgcccatgctaaacttatttattagctctacaatgcttatttttattctttgtgattttctntgcagacatttgtcatcttcaggatgattggaaaggatgaagcactaatattaataaatacaataataattaattatattttattttatcctttccagtcagtatgctttttatttatttatttatttatttatttatttattttttatttatttatttttgagacggagtcttgctctgtcaccaggctggagtgcagtggcgtgatctcggctcactgcaacctccaccatctgggttcaagagattctcctgcctcagcttcccgagcagctgggactacaggcacacgccgccatgcccagctaatttttgtctttgtactagaga

SEQ ID NO: 224 - DNA, 661 bp, Homo sapiens
  SYCP1
  misc_feature [331]..[331]: Chromosome 1, SNP identification no. = rs12135023
  misc_feature [331]..[331]: allele = a, in linkage disequilibrium with rs360659, respectively
  misc_feature [331]..[331]: n is a, t, c or g
gtagagctccttttagcagttattgtagtgctaacttggtagtggcgaattctctcagcatttgtttgtctgaaaaagactttatcttttcttcatttttgaagcttagttacactggatacaaaattcttggctgataattattttgtttaaggagcctaaagataagaccccagtccctactagcttgtaaggtttctgctgagaagtctgctgttaatccaataggttttcctttataggttagcttgatgcttttgcctcacagctcttaagattctttccttcatcttgactttagacaatttgatgactatgtgcctagattacnatcttttgcgatgaatttcctgggtattctttgagcctcttgtatttggatgtctagatctctagcaaggtcagggaagttttccttgattactccctcaaataaattttccaaagtcttagatttctcttcttcctgaggaacacaaattttcttaggttggtttgtttaacataatcccaagcttcttggaggctttgttcatttttttaaaagtattttttcttttttattatactttaaattctgggatacgtgtgcagaacatgcaagtttgttacataggtatacatgtgccatggtggtttgctgcactcaccaatctatcat

SEQ ID NO: 225 - DNA, 661 bp, Homo sapiens
  SYCP1
  misc_feature [331]..[331]: Chromosome 1, SNP identification no. = rs1591899
  misc_feature [331]..[331]: allele = a, in linkage disequilibrium with rs360659, respectively
  misc_feature [331]..[331]: n is a, t, c or g
tttctctctccggagtttatttattttactctcttccttttcctctgtaatgttagttatggtgtctttaagtttcctagcgatctccaatgatactccatttatatacggttatttaaaattttggatttttatttatttaaggatcggtgtatgttagatgtttctaacttggtacttctttaggttttgaacttatttagttattgtagatcgttctaacttcgatattatttttcagagggtcgtttctttttggatcctgggttaccgaaatgacgttttaaaatggtttgtaaatttcttcttaattatggtggggacgagtttnataagactttttatctcctctcccccaatgaaggtttgagtaagatactccggtcatcatgggaatttggttttggtctgtgtttctgtgtagtttttttcttttgatttccgggtatagggcctacttgtaactacgtttttaggagttttttatgctcgtttggtttaagttgttgtgtaactttgtagtaagtagtaccgacacactaaatagggtacctacgttcttactaagttgtatgtgtttatttagtcacactatatagtatagtttggtatactagtaaagttaactacgactttttcgaaaactattttaaattgtagg

SEQ ID NO: 226 - DNA, 661 bp, Homo sapiens
  SYCP1
  misc_feature [331]..[331]: Chromosome 1, SNP identification no. = rs12125190
  misc_feature [331]..[331]: allele = t, in linkage disequilibrium with rs360659, respectively
  misc_feature [331]..[331]: n is a, t, c or g
tatagatgaataaatttaagcttggagatacttgaagatttacttaaataatccggaaagataggaaagatctaggagaaaagaccatatgatgtacctggctcctagttcaatgatttttttatagtacatgtagttgcctctttatcctatactctaatttaaacgcactgaaagttcagccaccatgctttcaaattttgtccttgtattccctttttgtgtgtgtgtgctctagagaattcagagaaaggagagatgttctcagaagaacatggtcctgtaaaggagggctctacaatgaaaggcagtaggagaactgaaagaacangattctagaaaaaggggaatttgagtttcacagctaactagctgtggaattgagtaaattaacatgcctcaatttccttacaatttccttatgaataattgccacgattgtattcgtggagatggtggtgaccaaagaaactgtaaaatagaaagtgatgagcatgagtttcatgtagaatcccactaaagcaactattactagcttttactagaaagttaggtcaggtgctaaaagaagctgtatacaaaggtagagtgaaagagaactgaggaaactgagttgaaaaaatgtcaagtatttagagtaaacttgcaatttatttattta

SEQ ID NO: 227 - DNA, 661 bp, Homo sapiens
  SYCP1
  misc_feature [331]..[331]: Chromosome 1, SNP identification no. = rs12026343
  misc_feature [331]..[331]: allele = t, in linkage disequilibrium with rs360659, respectively
  misc_feature [331]..[331]: n is a, t, c or g
tttaattaaagaaataaataattaatgtgacatttagtgatggttttattcattcttgttgttcaatgcagaaaacacaaacatttttattggaaacacctgaaatttattggaaattggattctaaagcagttccttcacaaactgtatctcgaaatttcacatcagttgatcatggcatatccaaagataaaagagactatctgtggacatctgccaaaaatactttatctacaccattgccaaaggtttgtgtctaaattttccatgttagtagtaattttttaaataaataaataaagttctgttatcaccatatatctggcatcangcacacatatataactagtttcttgaaagtttcaattttttttgtggtatcagcatgaaatgtaaagacaaggtcttgctgtgttgcctaggatggtcttgaactcctggccttaactcatcctcctgtcttggcctcccaaagtattgggattataggtgtaagccactgtgcctggccttcaacatgaaattgtttcatttttttcgatcactgtccacaacttaatgtcatcttgggcagatttcataacttaatagttatttatcagtgtttaaggccctgacacaggaaatctgattctgacttgacattttatagcatcaccac

SEQ ID NO: 228 - DNA, 661 bp, Homo sapiens
  SYCP1
  misc_feature [331]..[331]: Chromosome 1, SNP identification no. = rs7416955
  misc_feature [331]..[331]: allele = c, in linkage disequilibrium with rs360659, respectively
  misc_feature [331]..[331]: n is a, t, c or g
agttaccaaagtataatattcaaatgtccagttttcaacaacaagggccaggcacaatagctcacgcctgtaatttcaccactttgggaggccaaggtaggaaggtttcttgaggccaagagtttgagactaagttgggcaacagtgagaccctctctatacaaaaatttaaaaaattagccaggtgtggtggcacatggcctgtagtctaactactcaggaggctgaggtagaaggatcacttgagcccaggagttcaaagttatagtcagctatgattatgtcactacactccagcctaggtgacagagtgagaccttgtctctaaaantttttttaaaccaaaagaccaatagtaacaaatcataaggcatacaaataaataggaaaatatgatccattcaaaggaacaaaacaaaccaacagaaattatccttgaggaagctcagacattggaattactagacaaagacttcaaaacagctgtcttaaagtagctcaaattgctaaaggaagacatggacaaagaaaaaaaaaccctaattttgtgtgaataaaatgagaatattgatagagagttagaaattataaaaagaaccagaaaaaaactctggaactgaaagtacaataaccgaaatgagaaacccactagagggattta

SEQ ID NO: 229 - DNA, 661 bp, Homo sapiens
  SYCP1
  misc_feature [331]..[331]: Chromosome 1, SNP identification no. = rs4839017
  misc_feature [331]..[331]: allele = g, in linkage disequilibrium with rs360659, respectively
  misc_feature [331]..[331]: n is a, t, c or g
taaaaaattagccaggtgtggtggcacatggcctgtagtctaactactcaggaggctgaggtagaaggatcacttgagcccaggagttcaaagttatagtcagctatgattatgtcactacactccagcctaggtgacagagtgagaccttgtctctaaaaatttttttaaaccaaaagaccaatagtaacaaatcataaggcatacaaataaataggaaaatatgatccattcaaaggaacaaaacaaaccaacagaaattatccttgaggaagctcagacattggaattactagacaaagacttcaaaacagctgtcttaaagtagctnaaattgctaaaggaagacatggacaaagaaaaaaaaaccctaattttgtgtgaataaaatgagaatattgatagagagttagaaattataaaaagaaccagaaaaaaactctggaactgaaagtacaataaccgaaatgagaaacccactagagggatttaaaagcagatttgagtaagcagaaaaaagaattggtgaacgtaaagatagacaattgaagttactgagtctgataaacggcaaaaaaaaaaaaaaaagaaaaagaaaagaaaagaaaagtgaacagagcctcagagtcttgtagcacaccatcagctgggccaatatata

SEQ ID NO: 230 - DNA, 661 bp, Homo sapiens
  SYCP1
  misc_feature [331]..[331]: Chromosome 1, SNP identification no. = rs11102859
  misc_feature [331]..[331]: allele = t, in linkage disequilibrium with rs360659, respectively
  misc_feature [331]..[331]: n is a, t, c or g
gaacaaaacaaaccaacagaaattatccttgaggaagctcagacattggaattactagacaaagacttcaaaacagctgtcttaaagtagctcaaattgctaaaggaagacatggacaaagaaaaaaaaaccctaattttgtgtgaataaaatgagaatattgatagagagttagaaattataaaaagaaccagaaaaaaactctggaactgaaagtacaataaccgaaatgagaaacccactagagggatttaaaagcagatttgagtaagcagaaaaaagaattggtgaacgtaaagatagacaattgaagttactgagtctgataaanggcaaaaaaaaaaaaaaaagaaaaagaaaagaaaagaaaagtgaacagagcctcagagtcttgtagcacaccatcagctgggccaatatatacattgtaggaattccagaaggagaagagggagagaggaagaggtgggggggtagacagagagagaaaaagagagagagaggtggaaagagttatatgaagaaataaatgctaaaaacttcccaaattttgatgaaagacatgaatatacaaattcacgaagctcaacaaactccaaaaagcccccatcaagacattttataatcaaactgttgggagaaaaaatgaatcttgaaagca

SEQ ID NO: 231 - DNA, 661 bp, Homo sapiens
  SYCP1
  misc_feature [331]..[331]: Chromosome 1, SNP identification no. = rs6698174
  misc_feature [331]..[331]: allele = c, in linkage disequilibrium with rs360659, respectively
  misc_feature [331]..[331]: n is a, t, c or g
ggctgaggtgtaaggatcatttgagcctgggaggtcagggatgcagtgagccataatcacaccactgacctccagcctgggtgacagaattagatcctgtcaaaacaaaacaaaacaaaaaaccaaaaaaaaccccaaaaacaaaacagggaagatggagctgtgtaggggcagagtttttataggctattgaagttcagttggtataaatttgaattagattgttatagcattaggaagttaaatgtaatctccatggtaactacaatgaaattatataatatacacaaaaagaaatgagaatggaatcagaatgttcaagtacaaaagncacctaaatggaaaataagacagtaatggaggagacaaaaccctataataatggagacaaaaccctataagacatattgaaaacaaatagcaaaattcagagctatgtccttccttatagatcattactttaaatgtaaatagattatactctcctatcaaaagatatagattggcagaatatattttaaaaacatgaaaactatatgctgttttcaagacactcattttagatccaaagccacaaattgataaaacgtgaaagaatggaaaaagatattctgtgcatatagtaaccaaaaaatagctgaagtgtctatactactatcag

SEQ ID NO: 232 - DNA, 661 bp, Homo sapiens
  misc_feature [331]..[331]: Chromosome 1, SNP identification no. = rs7536888
  misc_feature [331]..[331]: allele = t, in linkage disequilibrium with rs360659, respectively
  misc_feature [331]..[331]: n is a, t, c or g
aaagtgtttaggtggcaatcttaacttccagtttagtggaatcattgttgtgtctcctggtggcagcattcctccctctggaatctaagacatctaggccagcagaacataatgttgcaggaacaagaagcaaaaattttgctagtgggtcactaggggtgatggtgagtggtgccagttccacttccacccattgatttctggacccgtgaatcctggctatgggagaaacagtaccatatattggatgctaattcagagtatacacagccttctggagaactttgccgcagccttgcaaagtattattacatagttggtgttgtaattntgacttcaaaagcccattccaccgttctatcaatccagctgcttaaagataatggggaacatagtaagaccagtaaattccataagcatgagcccacggctgtacttctttagccataaagtgagtgccttggtcagaggcaatgctgtgcagaataccatgatggtggataaggcattctgtgtgcccatggatggtagtcttggcagaagcattgtgtgcaggataggcaaagccatatccagataaagtatctattccagtgagaacaaactgctgctctttgcatgatggaagaggtccaacataatcaacctgccaccaagtagc

SEQ ID NO: 233 - DNA, 661 bp, Homo sapiens
  misc_feature [331]..[331]: Chromosome 1, SNP identification no. = rs4839399
  misc_feature [331]..[331]: allele = t, in linkage disequilibrium with rs360659, respectively
  misc_feature [331]..[331]: n is a, t, c or g
tagtgtgtggcacttacctcttctctttctcactctctctgctgccaccatgtgaagaaggtgcttgcttccccttcaccttctgccatgattgtaggtttcatgagggctcccagtcatgctttctggtatagtctgtggaactgtgagtcaattaaacctcttttcttcacaaattaccaagtctcaggtagttctttctagcagtgtgagaacagactaatatatagtgtaagaaacttacttacagaaatatatttctatttcttattcctattctctcttttattcttgacatactatttacttctacaaacaccacaataattantaattttgctttaagctgtcaattttctttttaagaaaattgaggtaaactttacacaaggaaagtaaccattttaaagtgaagagctcagtggcatttaatacattcacaatgttatgcaaccacaacatctctctagttccaaaacatttttatcaccccaaaagaaaactctgtactcattaagctgttattttccattccctactctctccagcctctggtaaccaccagtcagctttttgtctccatgcattaacctattatacatatgtcatataaatgcactcatacaatatgtgacattttgtatctggcttctttcacttc

SEQ ID NO: 234 - DNA, 661 bp, Homo sapiens
  misc_feature [331]..[331]: Chromosome 1, SNP identification no. = rs11102872
  misc_feature [331]..[331]: allele = a, in linkage disequilibrium with rs360659, respectively
  misc_feature [331]..[331]: n is a, t, c or g
cttatggaagcacaaactatttttagacgtaagtaagctcgaggaattgttcagcctcctgattttcagtgatctttccttggcttcctagtttcaaccccatcatatacaaattggtcatcagttgaagactcaatgaaaacccctttcagatctccagattttctttctaggcagctccctcctcttcatttctctgtcctaaaaattctaggcatttcagactccctgaacttctatacgtttcttcacaattccttaagagtatagtctctttttggctccccctctctgtgctgtagcctagaaactgccttcaggtttctagganaatcgtagggcttaatttatttgtttcttttctttcagtatcagccttgtggtgcctattatccaaagtttatgaataattggttcatatattttgccctgttttctaactgtttttagtagaagagaaattcttataccagtgaatccttgatgggtgaaagcagaaatatgtggggcttttgggagaagctgaatagtctgggcactgaccaatgaaaacaatggttagtagtgctggagtagagactgggaggcctcctcttgtgccaggcagggaagagcttttccctactcttgacttccttgaaatcaaaatgtgtttacctaa

SEQ ID NO: 235 - DNA, 661 bp, Homo sapiens
  misc_feature [331]..[331]: Chromosome 1, SNP identification no. = rs7515454
  misc_feature [331]..[331]: allele = t, in linkage disequilibrium with rs360659, respectively
  misc_feature [331]..[331]: n is a, t, c or g
tttgattaatttttgcatataatcatactgcaaacttctttagaaataaaaggtgtgctaaaaaaagataagaaaagtttaaaatttttggatgagattaatagcatattgttcattagttgctgagaagtggttatacctgttattgtgaatacaattaatactgctcacattattcagccagataaataatatctaattaccaagaggttatataaagtaacataagtagaaagaaagatattatactaagggatagagaaactagttttgacagacaggtaaggaaaattggataccaagctgactttataacactacaaattttatnacagaagatgttagcaatttctattaacatttatagatgaccttaatttcaaaaaatgttttgaaatagaaaagaacttgcatacattcatgtaaatctggtatacaaggggctttaatctgttaccaaaagagaaaagcaaattgacataatttttatacatattaaatcaattttgtcttctcacttgagagctttaaaataataaaatgctcaatatgcagatagggtgaactctgtttgctaccaattatctgtattaagaaaaaaagcatggaaaggaattaagtaaacaaacaggttttgtttcatgttgcaggccattttaat

SEQ ID NO: 236 - DNA, 661 bp, Homo sapiens
  misc_feature [331]..[331]: Chromosome 1, SNP identification no. = rs7517739
  misc_feature [331]..[331]: allele = a, in linkage disequilibrium with rs360659, respectively
  misc_feature [331]..[331]: n is a, t, c or g
tcattagttgctgagaagtggttatacctgttattgtgaatacaattaatactgctcacattattcagccagataaataatatctaattaccaagaggttatataaagtaacataagtagaaagaaagatattatactaagggatagagaaactagttttgacagacaggtaaggaaaattggataccaagctgactttataacactacaaattttatgacagaagatgttagcaatttctattaacatttatagatgaccttaatttcaaaaaatgttttgaaatagaaaagaacttgcatacattcatgtaaatctggtatacaagggnctttaatctgttaccaaaagagaaaagcaaattgacataatttttatacatattaaatcaattttgtcttctcacttgagagctttaaaataataaaatgctcaatatgcagatagggtgaactctgtttgctaccaattatctgtattaagaaaaaaagcatggaaaggaattaagtaaacaaacaggttttgtttcatgttgcaggccattttaatatgactgttactgataactcaggcttaagatggctaaactgattattttaaaagtgtctatattgcccaggattttagaattttatggatatagagaatagtaggagctaga

SEQ ID NO: 237 - DNA, 661 bp, Homo sapiens
  misc_feature [331]..[331]: Chromosome 1, SNP identification no. = rs7541251
  misc_feature [331]..[331]: allele = g, in linkage disequilibrium with rs360659, respectively
  misc_feature [331]..[331]: n is a, t, c or g
taaagtaacataagtagaaagaaagatattatactaagggatagagaaactagttttgacagacaggtaaggaaaattggataccaagctgactttataacactacaaattttatgacagaagatgttagcaatttctattaacatttatagatgaccttaatttcaaaaaatgttttgaaatagaaaagaacttgcatacattcatgtaaatctggtatacaaggggctttaatctgttaccaaaagagaaaagcaaattgacataatttttatacatattaaatcaattttgtcttctcacttgagagctttaaaataataaaatgctnaatatgcagatagggtgaactctgtttgctaccaattatctgtattaagaaaaaaagcatggaaaggaattaagtaaacaaacaggttttgtttcatgttgcaggccattttaatatgactgttactgataactcaggcttaagatggctaaactgattattttaaaagtgtctatattgcccaggattttagaattttatggatatagagaatagtaggagctagaaaagtacccaatctttggggtaaaggataatgtcagtaaatctgattcatattttaatgccacttctctgtttagctaagtaaagagtacgagtgtttgtttt

SEQ ID NO: 238 - DNA, 661 bp, Homo sapiens
  misc_feature [331]..[331]: Chromosome 1, SNP identification no. = rs6537849
  misc_feature [331]..[331]: allele = c, in linkage disequilibrium with rs360659, respectively
  misc_feature [331]..[331]: n is a, t, c or g
ttaccaaaagagaaaagcaaattgacataatttttatacatattaaatcaattttgtcttctcacttgagagctttaaaataataaaatgctcaatatgcagatagggtgaactctgtttgctaccaattatctgtattaagaaaaaaagcatggaaaggaattaagtaaacaaacaggttttgtttcatgttgcaggccattttaatatgactgttactgataactcaggcttaagatggctaaactgattattttaaaagtgtctatattgcccaggattttagaattttatggatatagagaatagtaggagctagaaaagtacccantctttggggtaaaggataatgtcagtaaatctgattcatattttaatgccacttctctgtttagctaagtaaagagtacgagtgtttgtttttctttgaaaatgagttaaaattttaatgcaacaaaaacgatgtcaagaaacttggattttagcctgactttgcctataactatctatagaacatcagagcattaaataacctctccatggatgcaaaatgtcagaataggatctatgtttccatttatttatgtaatcaatatttactgagtacctaatatatagcagaggctggtttggattctgaagatatggtgatgagcaagac

SEQ ID NO: 239 - DNA, 661 bp, Homo sapiens
  misc_feature [331]..[331]: Chromosome 1, SNP identification no. = rs1575070
  misc_feature [331]..[331]: allele = c, in linkage disequilibrium with rs360659, respectively
  misc_feature [331]..[331]: n is a, t, c or g
tgtttatacagtatatatacgtcatcttatacacagtcgtcatttatccttatttgatgactgtgtcgtcactgtacttgtagttattaatacaatattagaattacaataattctgtctggttttgtctcatgtacggtatattaagtcaaatatattttatggtcttttatgtttaatcacattctgtcgtctgattactaacggacccctactcctttccgttccttccccttctttctccctaaaggttccccgtctcctttataaatcctccactttttacacaagtaatagaactaacactactaccaaaatgtcctatatgtanacaattttggatggttttatatacgtcccaatccccaacttaatacatgggggttttaagtttacaacttcaagattggacatcatatagtcttacacttgaataaacctttattcaagtaatgtttactttaattaattatactttattatgacctcatttcatccggtgatcggttatactaacctatataggggaaggtttttctcctgtgaacctgtgtctgtgtacttgttcctcttacggtacacttcttactttaatacaacgaagtttggttcctgatggtcttcgacgttatctccggaccttatgtaggatcgagtcgtc

SEQ ID NO: 240 - DNA, 661 bp, Homo sapiens
  misc_feature [331]..[331]: Chromosome 1, SNP identification no. = rs1575069
  misc_feature [331]..[331]: allele = a, in linkage disequilibrium with rs360659, respectively
  misc_feature [331]..[331]: n is a, t, c or g
ggttagtaaggtgaggagtcataaatagattctctttattattctatataggtatgtacttgaacatgtatttgtaaatatcgtagaaataaaaattatcggggtttgacctttgttggacttacaggtaggtgtccactatttgtttatacagtatatatacgtcatcttatacacagtcgtcatttatccttatttgatgactgtgtcgtcactgtacttgtagttattaatacaatattagaattacaataattctgtctggttttgtctcatgtacggtatattaagtcaaatatattttatggtcttttatgtttaatcacattcngtcgtctgattactaacggacccctactcctttccgttccttccccttctttctccctaaaggttccccgtctcctttataaatcctccactttttacacaagtaatagaactaacactactaccaaaatgtcctatatgtatacaattttggatggttttatatacgtcccaatccccaacttaatacatgggggttttaagtttacaacttcaagattggacatcatatagtcttacacttgaataaacctttattcaagtaatgtttactttaattaattatactttattatgacctcatttcatccggtgatcggttatactaacc

SEQ ID NO: 241 - DNA, 661 bp, Homo sapiens
  misc_feature [331]..[331]: Chromosome 1, SNP identification no. = rs12136420
  misc_feature [331]..[331]: allele = g, in linkage disequilibrium with rs360659, respectively
  misc_feature [331]..[331]: n is a, t, c or g
gtattgaagttatttatttatttttaaaaagtatttatttttatatatggataacgaattgttccagcaccatttgttgaaaatactatttattttctactcaattttgttttcacctttcttgaaaataatttgaccacatgtgtacaggtttattactggaccatattttgttccaatgatctgtcttaacaccactttcttaattaccataggtttaccatcttgaaatcagcgattcagtaagattttcaacatagatggtcatgtcgtatgtgaataaaattttactccttcctttcccatctgaatgtcttttttcctttggctnattgcgttaacattgcacttacagcacagtgtttaatagaagatgcaaaagcagacgtttttgcctttttcctgatcttagagtaaacgtactctgtctttcaatattaagcatgatattaatcataaattttccatgatgccttttattaagttaggaggttttcttctattccaagtttgccgaaaattttttcaggaatctatgttggattttgtaaaatgctttttgtgtatgtggttgtgtgtgtgtgtgtgtttccattgggatcatcataaggcttttagtttttagcccgttagtagggtgaattttcttaattgaatgcaa

SEQ ID NO: 242 - DNA, 661 bp, Homo sapiens
  TSHB
  misc_feature [331]..[331]: Chromosome 1, SNP identification no. = rs7530810
  misc_feature [331]..[331]: allele = a, in linkage disequilibrium with rs360659, respectively
  misc_feature [331]..[331]: n is a, t, c or g
gatccatggactcccaggtctatctcttcaatttggtgatgcttctggcctctgccttggtaacttttcatgcactatggcacagaaactttctccaggcagtctctccctgtttgtttcccatctctctcggatcatgtacttttgttacctgatgtccaatatgtataaagacattattttatatattttgtactgttttataattattttaggtgagaaagtaaacctggatcagaagcacaaattcaacatgcctggattcttttaacagtatgagatcatatacactaaggcctctttagcaagaaaatcactacccaaatgcatngtatttattatagttcttttagtaacaggccaagtgtctatcagttgtccattacatatgtacacacacacatacatacatatatctcccagggataggtatataaatccgctagaaaatgagttcctgaatcaatgctttatacaaaggaggcactaattccattagaaacacacatccaacattcttccatttatcatattcctgtgttagcatcttgtctgaaattaggttggcacactcatttccagtttccctgttttcaaaattatcttactacatagtagctcacattcccaagaccttggaccctggcatggccatttctag

SEQ ID NO: 243 - DNA, 661 bp, Homo sapiens
  TSHB
  misc_feature [331]..[331]: Chromosome 1, SNP identification no. = rs7523360
  misc_feature [331]..[331]: allele = g, in linkage disequilibrium with rs360659, respectively
  misc_feature [331]..[331]: n is a, t, c or g
gttgtccattacatatgtacacacacacatacatacatatatctcccagggataggtatataaatccgctagaaaatgagttcctgaatcaatgctttatacaaaggaggcactaattccattagaaacacacatccaacattcttccatttatcatattcctgtgttagcatcttgtctgaaattaggttggcacactcatttccagtttccctgttttcaaaattatcttactacatagtagctcacattcccaagaccttggaccctggcatggccatttctaggtatatatctgttaaactaaatgtggcctgaggatacctctgtnttgtgagttcctacataatgaactgcaacctaacttagtatgtacactacctgaaagcctaacttaggagtatacttttgtaacagacagctgaatttcagctcatcacagcagctgagcttcagtcaattacaggcagccagctgatcagactttgtccaagtaaggcaagtgctgatgtataatgaaatcaagctgtttcgatatctcatttctactttctgtccataaatgctgtctgcccacattgaggagcagagctctgtgaatctcttctgattctgagggctgcctgatttgacaatcattcttttttcaattaaactgaca

SEQ ID NO: 244 - DNA, 661 bp, Homo sapiens
  TSHB
  misc_feature [331]..[331]: Chromosome 1, SNP identification no. = rs1321108
  misc_feature [331]..[331]: allele = g, in linkage disequilibrium with rs360659, respectively
  misc_feature [331]..[331]: n is a, t, c or g
agttacttaaaaaaggaataggaatacatccatcaagagagtggaggtagatgatgatttgttaaacctcgtcattaaattctataatgtcggacaacttcgtttaatagaaagtcgtaaacggtgaaagattttttactattttaccactttcacttttttttatcgaattcttgtatagtaaagtgtctcggaagagtgatatctgtggatggaatgaaacgtaaccactcgtctacgacaccactgggtttgattttcgagaaccaagtaaaatatgggaagtcctattagggagactagaagaacaaatatgttaacgtaaactaantgacgaaagaatagacttttcgtagataacttttaagtatgacttaaggtttattttacataaatctgtttgttcgagtgttatagaaatggacctttgactgtaataatttcgtacgtaaaaggagagaagacaaagttttattttaatggaaaatttatataagaaataattataaataaataattataattattttctatctatgtcttaccctttttggtttaagttttttgtgagattgtagtagatttattcagaacccttatttttaaataaaccccgaactcccgaagttcaaaatggatttacaagtacatttctatatat

SEQ ID NO: 245 - DNA, 661 bp, Homo sapiens
  TSHB
  misc_feature [331]..[331]: Chromosome 1, SNP identification no. = rs11102874
  misc_feature [331]..[331]: allele = t, in linkage disequilibrium with rs360659, respectively
  misc_feature [331]..[331]: n is a, t, c or g
aaaaatgaaggcacaaagatattaaattgctcagttgcacacaattacaattaaatccttaagtagaatttagatcactaactcttaatcaatcaatcagatctgacactaatttatcatatagaattacagactatttgtgctgcgaagattttcatgatcatcttctggctctaagccctgcttttataggtgagaaagttgaggcccagaaagattctgtgggtgaagttttactattcgcaataaagaagtaaaggaaaagaaaagttcttgctttctttatgcccacaaagttgtacagatactgtggctggtaattcagcacttncattttctacttttgttagtttagagttctacatttataggagaaacttcaaaaaaatatagagtatccatagttagtatgacaataggaaaaccaaaacaaattttcatcctacattttaaaaagggtcaggtgtacttgtcactttctattttgcagatggggaaataacactcaaacagattatatattttagtcaagttctcatagatttatggaagaattctgtttcttaatttttagaccaatattttcatcaccaggtcaccacattgattttatacagaattatagagctaaaagttaaaatatgtgaagttagttgtttcc

SEQ ID NO: 246 - DNA, 661 bp, Homo sapiens
  TSHB
  misc_feature [331]..[331]: Chromosome 1, SNP identification no. = rs3754363
  misc_feature [331]..[331]: allele = a, in linkage disequilibrium with rs360659, respectively
  misc_feature [331]..[331]: n is a, t, c or g
ctatagtaatagttatacataactaacctatatcaatataacctatactatagtataacctatatagtatagttatactataactatactataactataactatagtaatagggagacctattacaatactgtattaataaaatccagatgatgactccttcccattaatttaaagtctgaaaacttacattcaactagtggaacttctaattcttcttaaaaaaattagaatgtttataacatgtcgatcgatctacacaaacctaaaaaaaggaagagttcatagtaacagtcatttcttttatatatggaattacctcatcataacancagatacttgtatttgaacaaacgaacaagataatttattttatattaaatgatttataaaacaagttattagtcttcatggttctaaaggggtttagacagtcaatatagggttgtcgtagaaattcgatatatgtgattttggagacatttgactttggagtatccaagccggaaccaattggtcctaaaaaaaaagttagttgaatattctttggtacttttggtgtaatgtgtccaatggtccctaaataaaatttacagtttaaggtctctagtcaccagtaaagttagttggaagataaggatcttactcttaacatctattta

SEQ ID NO: 247 - DNA, 661 bp, Homo sapiens
  TSHB
  misc_feature [331]..[331]: Chromosome 1, SNP identification no. = rs1321107
  misc_feature [331]..[331]: allele = a, in linkage disequilibrium with rs360659, respectively
  misc_feature [331]..[331]: n is a, t, c or g
tttttttccaactgtgttaatcttcttatgttagttcctactgtcgaggtaatacccaatcggtccttataatttattaaaaacctacgtaccttcttttatctcctaggtgtcacggagtccgtctttgtcttgtacgtagagttatctcggacgcactacttcttgaacaagttatagttaacctatagtaatagttatacataactaacctatatcaatataacctatactatagtataacctatatagtatagttatactataactatactataactataactatagtaatagggagacctattacaatactgtattaataaaatcnagatgatgactccttcccattaatttaaagtctgaaaacttacattcaactagtggaacttctaattcttcttaaaaaaattagaatgtttataacatgtcgatcgatctacacaaacctaaaaaaaggaagagttcatagtaacagtcatttcttttatatatggaattacctcatcataacaccagatacttgtatttgaacaaacgaacaagataatttattttatattaaatgatttataaaacaagttattagtcttcatggttctaaaggggtttagacagtcaatatagggttgtcgtagaaattcgatatatgtgattttgg

SEQ ID NO: 248 - DNA, 661 bp, Homo sapiens
  misc_feature [331]..[331]: Chromosome 1, SNP identification no. = rs7514765
  misc_feature [331]..[331]: allele = t, in linkage disequilibrium with rs360659, respectively
  misc_feature [331]..[331]: n is a, t, c or g
cttttaatgtaatgaaaaactggtatgacaataaaaggttttagggatgggggagagtgcaaagggatttgagagagtggaattattctaaattctaatctaaaccttcatcaatattgaaacactgttttctggtaaatgtgcttggtaagcagctgtttatttttattctccttccttagacactctttcatgagaatttggtttcaacagatgattgacgtgagacagacccagtgccctgtagacttgatctcaaaaagttgatatatcctctctttgtccattccttttcattcacactgccccaccaaggtgaaaaacagttgtnagcagggccagttgcctttgctgtattctatagccaccagttaaattcagctaggcatactgtaaatgtctgtatgctgattgatagtgcatggggtgggctgaggagggtggtggtggtagtggtggggtcctgtagatggattagtacaacagggagggaatagatgtgtatttacatacaaaagtcagaactcacattattttactttaatatctgaaattggtatttgtgtggtctccacatattaatctagggttttgtgttctcatatcagctgataacatggacatttaaagctgcataccacttaaactgtatgtcaaatac

SEQ ID NO: 249 - DNA, 661 bp, Homo sapiens
  misc_feature [331]..[331]: Chromosome 1, SNP identification no. = rs1998008
  misc_feature [331]..[331]: allele = c, in linkage disequilibrium with rs360659, respectively
  misc_feature [331]..[331]: n is a, t, c or g
cctccttctccaagatgactcaaaatctatgccatggtctttagcaggcaacagtaatgtaggtctggactgtatttttgcttggtgattttgcttgattctgtagcgatgaagattctaaactttgtgaaaggagggccagtgtggtgataactttatgtgtcatattgacactttggacattgttaaatgtacagcatatgagaaacttgggtttgtattaattcagccttggatatcctaaggatttatactcattaaagacagttttgatggcagttgttaaagaaacacaggcagctaagaaagactctccaagtttaggataagnaataggtggggagcaaagaattactgcgggattttaacttactaaagtaagtttaaaactttcttgctggggatttaatcataagaggtggcttatcttgttcaaatatgggcatgaccatgcttatattgattcctacagttttagttcagacttattttcctgagcttcagggccatatatctagtgcttgtttatatttcctcttgggtatcctataatcatctccaccccatgtcatcatcacaatctgcttttcctcctgtgtaccactatcttccacctgccaagtcggaaacctgggaattactccagattcctctttttctt

SEQ ID NO: 250 - DNA, 661 bp, Homo sapiens
  misc_feature [331]..[331]: Chromosome 1, SNP identification no. = rs4611011
  misc_feature [331]..[331]: allele = a, in linkage disequilibrium with rs360659, respectively
  misc_feature [331]..[331]: n is a, t, c or g
gagagagagataaacaacataaaaagttaaaaatggagacattaaaaagtcaaaaagtgggggaagatgagttaaattgtagggttttttagtttcttctaaaaacaactaaaaaacttggttgtttgcttcttttctttgtgatgaaagttaccagtttaaaacaagttattataactataagattttttgtctcataacaatcacaaagcaaaaacctataatagatacagtaaaaataaaaagcaatgaattaaaatgtattaccagggaagataaccacagagaaagatagtaagaataaaataaaggacttaagaaccagaaaacnaacaataaaatggcagtagtgtttacctatcattaattacattgaatgtaaacatggaccaaattctccaatttaaaagacacaaggtgactgaatgaatgaaaaaacaagacccaacactttgtctctttttaagtcagaaactgcaaaaagagacaaagaaggtcattatgtaatggtaaagggatcattctgcaagaggatataacaattgtaaatataattgtacccaacatcagagcacaaaaagagagctagattccagtacaataatagtagggaacctcaaaacccaacttttgccaataaatagatcatacagagagaaaa

SEQ ID NO: 251 - DNA, 661 bp, Homo sapiens
  misc_feature [331]..[331]: Chromosome 1, SNP identification no. = rs7413646
  misc_feature [331]..[331]: allele = c, in linkage disequilibrium with rs360659, respectively
  misc_feature [331]..[331]: n is a, t, c or g
acctatcattaattacattgaatgtaaacatggaccaaattctccaatttaaaagacacaaggtgactgaatgaatgaaaaaacaagacccaacactttgtctctttttaagtcagaaactgcaaaaagagacaaagaaggtcattatgtaatggtaaagggatcattctgcaagaggatataacaattgtaaatataattgtacccaacatcagagcacaaaaagagagctagattccagtacaataatagtagggaacctcaaaacccaacttttgccaataaatagatcatacagagagaaaattaaaaaaaagaaacatgaaaagtnaactacactctagaccaaatggacataactgacattttcagaacactcatcctactgctgcagaatacgcattcttcttgccagcatatgaaaacattctccaggaaagacaacatgcaagggcacaaaacaagtcttagcaaactcaaaaaattgaaataatatcaaatattcaggctgcaatggaataaaatctagaaatcaataacaagaagaacactgaaaattgaataaatacatgaaaattaaacaacatgctcctcaatgaccaatgggtcaatgaagaaattaaaaatattttttaaattcttgaaacaaatgaaaatagaa

SEQ ID NO: 252 - DNA, 661 bp, Homo sapiens
  TSPAN-2
  misc_feature [331]..[331]: Chromosome 1, SNP identification no. = rs11102878
  misc_feature [331]..[331]: allele = c, in linkage disequilibrium with rs360659, respectively
  misc_feature [331]..[331]: n is a, t, c or g
aaatatttcaacattaagaagtcttaattcagtgccttggcatgagacatttaaaagcatgtttgggtctaatctcaaattagttcaggggaacagaaatagctgaaaatttatgtatatgtgtatgtatatatatatatacacacacatctgtatatacatacatgtatatattcaaattatatacatataaagatatttgtagattcaagatatatagggattatatatctatatatattatatgtgtgtctatacagatatatatatatatatattcatctttctgtgtgtgtgtgtatatatatccacacacacatataaaatctantgttgcttagtggtggaattctctaattttactcatacgcatattttggaaagcttatctccaaaaggggcacattaatcgtacatggaacagaacccttctcttctactttaattaatttcattttaaatttatttatttctattcttccacttttaactattatagtctcctttaaagttgttaattcagataggaaactaaactcacttttgtggaatcagagatgattctgagttggaaagaacccgagtatgcacttgggcctgtttcctgtcttcaggcagagagataaactaaagctaagagagatggactgcctgttctttg

SEQ ID NO: 253 - DNA, 661 bp, Homo sapiens
  misc_feature [331]..[331]: Chromosome 1, SNP identification no. = rs4636400
  misc_feature [331]..[331]: allele = g, in linkage disequilibrium with rs10494240, respectively
  misc_feature [331]..[331]: n is a, t, c or g
aataaataataagcaaactaaaatcaatgtgaatttaacagaaagtgagatttaaaagatccttttccatttcaatcctcatttttcgtttatctttcattttccatagcactctcctccctctctttgtctctctttcattaccaaagtgtcagtctctatttctccctattgccagggtgactttcacctgaactctccgcccctttctcacctgtgcaagaatttagtggctcctctccttcaaatctgtgaccaggaaattaggtcaaagttgatggaaaagttttttctgtagcttgttttccagggcctagaggggtgaagcaangataagagcaggccagagagcaggacaaaggaatggagagaccatggagtacatgagcctggttgtgtgcacagttgggctaccagtacccaatatgagaagagggatggcttcgaaaggatagataactttatacccaaggcctcttagagatctgatcctagggccaggcgcggtggcttacgcctgtaattgcagctactcgggaggctgaggaaggagaatcacttgaacccaggaggtggaggttgcagtgagcccagactgcaccactgcactccagcctgggcgacagagcaagactgtctccaaaaaaaaaaaaagagctct

SEQ ID NO: 254 - DNA, 661 bp, Homo sapiens
  misc_feature [331]..[331]: Chromosome 1, SNP identification no. = rs6688400
  misc_feature [331]..[331]: allele = t, in linkage disequilibrium with rs10494240, respectively
  misc_feature [331]..[331]: n is a, t, c or g
tctaacgggaaaaacagacaataaacaagttagaaagtaaacaaggtaattaaagattctgactggcctaagcaacatggcaagactccgtctctacaaaagattttttaaaaattagccgtgtgcagtggcgtgtgcctgtagtcccagatattcgggaggctgaggcaagagaatcacttgggcctgggaggttggctgctgtgagccataattgcaccactgcactcagcctggttgacagagtgagaccttgtcttaaaaaaaaaaaaagaatgaaagaagattctgatttaagttctgtgaaggaaatacacagttaaagacaggngggtagagaagacccctttgggtgacagtactattgagatcttaaaaatgaggtcgaactcggccgggcgcggtggctcacgcctgtaatcccagcactttgggaggccgaggtgggtggatcacaaggtacggagttcaagactagcctggccaatatgctgaaaccccgtctctactaaaaaaattttaaaaagctgggcgtggtggcacgtgcctgtagtcccagctactccggaggctgaggcagaggaatcgcttgaacccagtaagtggaggttacagtgggccgagatcgtgccactgcactccagcctgggtgacagagcga

SEQ ID NO: 255 - DNA, 661 bp, Homo sapiens
  RBM8A
  misc_feature [331]..[331]: Chromosome 1, SNP identification no. = rs872786
  misc_feature [331]..[331]: allele = t, in linkage disequilibrium with rs10494240, respectively
  misc_feature [331]..[331]: n is a, t, c or g
tatctttccgcactaggcccgccccaatttgcgtgtttttaccgtgcagagggagggatttagagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggntgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgggttttggagtccccacccacctcataggaa

SEQ ID NO: 256 - DNA, 661 bp, Homo sapiens
  ITGA10
  misc_feature [331]..[331]: Chromosome 1, SNP identification no. = rs2274617
  misc_feature [331]..[331]: allele = t, in linkage disequilibrium with rs10494240, respectively
  misc_feature [331]..[331]: n is a, t, c or g
agtaaaagggccgaaaccgaaagaacgactaagtcgattttaaggaggagactgggtcgaaagaggagtaagagtccgggactacgattcgtcaatgacgggagaggaatggtcgtgtaccttcacatcgacgagtgttcactgtaaggggtgtgactcggcctcggaggctcccctgttggagaccggtctcggtagtttacgacgtgcacggggtcgtcaggtaagtaggtcactacgccacttggagtacagacttacttcctccgttctcactcccacctttccccagatcactccttccgtacgttccttaactctcaacggacantacgtaaaatcagtgagtgtcttaaccactagggtcgctggtcctcatgccctccagtgaaccttcgtttcccgacgtcagtctgtctgacggagaaccggagcggcggatgtcagggagacttggtgtgactaccggacaccccagtggaggtcactaccccagtctacctgttacccggccctcgacccttgtcacaccttttctttaagatcgtcatcctccattcgggagactcttcacgttcgggtcacaaacgaaggggtaccagttttgtttcttcctccccgacttacgtgtacagtgggatggggcttgggagactgtctt

SEQ ID NO: 257 - DNA, 661 bp, Homo sapiens
  FLJ25124
  misc_feature [331]..[331]: Chromosome 1, SNP identification no. = rs12410298
  misc_feature [331]..[331]: allele = g, in linkage disequilibrium with rs10494240, respectively
  misc_feature [331]..[331]: n is a, t, c or g
aggccaaggcaggtggatcacttgaggtcaggaatttgagaccagtccggccaacatggcaaaaccctgtctctactaaaaatacaaaacttagcgggcgtgatggcacatacctgtaatcccagccacttgggaggctgaggcaggagaattgcttggaccgggaaggcagaggctgcggtgagtgagccgagattgtgccactgcacttcagtctgggtgagactctgtctcaaaaaataaaaataataataataaaaaaagaaacagtttgagtggctcttttgtgtgaaagtaatgagagatgggactgggaaagagggcggcagcntatgactcctgaagagccttgtaaaccacttaagaactttgggctttaccctgtaggttttcatatgcattttagtgagctctctccggcggggagaggagaaaagaaagacaggaagaccagttggctgcgactgactgttcaagaattaccaagagcctgaacttcaagggcagtggaaataatgaagacagttttttgtttggttattttttgtttctatgcgggggcgggggcggggggggcagcttaaaataaaattgctctcctcgctctctgctgttttctaattcagatgtgcgtttaaaaattgagcctgggccaggaata

SEQ ID NO: 258 - DNA, 661 bp, Homo sapiens
  FLJ25124
  misc_feature [331]..[331]: Chromosome 1, SNP identification no. = rs720899
  misc_feature [331]..[331]: allele = g, in linkage disequilibrium with rs10494240, respectively
  misc_feature [331]..[331]: n is a, t, c or g
tgacgggataaacgttcgaaagatactgaggttagacagacttctttgtcaaaagaaaggtcgatctattaagatttgggtaggttgaatgaagggtattagagtaatatcattctagaacaatatgattttcaaatcttacccaccagtaagaaataccagtttggagacatgtcgatcttagttcctcctgtctccctaccaaggtttaaggttttcggtcgggtgagtaaggtcgtggaacctttcctccatgacgggttcctaaccccctagtctttcttactttatcaaaggggtaaggattcttcgtccgtctgaggtgtttggncattccctttccgttgtaacttatgaaagtcattgattccttctcaggtatacttaaagatttttcagtaatactcaattctgactcagacccgtcggagtcaaagaccacgtatattatcatttatggaaaactaaccaactagttacacacctttgattcatctctacgtttacattcaccctgttcctgtccggagttgtctcaagtatgagaacggagtatcgaacgaaggtcctaagacattggacgggtacgtcttactcgattaacttgtaaagactataaaagaatacttgctatgatgattcagttcaatcgtttcgttat

SEQ ID NO: 259 - DNA, 661 bp, Homo sapiens
  FLJ25124
  misc_feature [331]..[331]: Chromosome 1, SNP identification no. = rs10494240
  misc_feature [331]..[331]: allele = g, a
  misc_feature [331]..[331]: n is a, t, c or g
ggacggtggtgtgggccgattaaaaacataaaaatcatctctatcccatagcggtacaaccggtccgaccagggtttgaggactggagtccactaggtgggcgaagtcggagggtttcacgaccctaatgtccgcactcggtgacgcgggtctactaggtcacggttaataaatttcgagagaagaccagatgaagaccagatggatccgtctcattcgagtatccattctatgggagttcctataggagatgaactgattttattttaccctaatatcctcaaccccaaaaaaacacacacctaaaaggatatatgaccattgaatctantcgaaattttactagtgacgaaaaagtcaggaatgagtctgactgtcacgtcccgagaccgggacctgggtttacacactcacctctacccatctccgtcagaaggtcacactgacccttcggtccgaaaacctcaccggtatttctgacggtgtgatgaagagactgtttaccaaggtctcatcaaacggtgggttttgtcacctccttaaatagtactcttcacacccctttaaagtactccttggttagacgtcgactttgacgggataaacgttcgaaagatactgaggttagacagacttctttgtcaaaagaaaggtcgatcta

SEQ ID NO: 260 - DNA, 661 bp, Homo sapiens
  FLJ25124
  misc_feature [331]..[331]: Chromosome 1, SNP identification no. = rs12125340
  misc_feature [331]..[331]: allele = c, in linkage disequilibrium with rs10494240, respectively
  misc_feature [331]..[331]: n is a, t, c or g
gaatggttatctaatcttggtatacttctgtttcttctgtcaaagagatggaataatagccctagctactttccagggatgttgagagactaattgaaatagcatgtgaaaggactgtgagaagttacaacttctgtacaggagtattacctcagaatccatctaccttagataattttatggtttggatatttagagctttcctgtggttgattaataatttgccctggctacgtaaacagtgtttgaaaatgagttactgggcttccacagaccctatttttcttcacccctttctatagcctcttgttgagattataccttataaaangctatgtgccaccaccaacaccccactacttcctgttttgttacaaggatgccatatatttgtatggctctttacagtttataaagagattttgtatatattagcttgtttaatagtcacagcatgatgaggtagttgttattagccgtattttatagaagaggaaacaggttaaaggtgtttaatggcttactttaggtcacatagccgagaatgtagctgaactaggtcccaaactcaggccagccagcgaaatatttgtctggcagcctttacatcagaccacagatctttgcatctgtctcttccttttcattcccttctctggac

SEQ ID NO: 261 - DNA, 661 bp, Homo sapiens
  misc_feature [331]..[331]: Chromosome 2, SNP identification no. = rs17697743
  misc_feature [331]..[331]: allele = t, in linkage disequilibrium with rs973128, respectively
  misc_feature [331]..[331]: n is a, t, c or g
agtgtgggttgggttttttgtctcttgcccagggaggagccctgactgccccacacagctggtgggcagcagggctgcactcattgcagggctgactagctccagggtccatgcactgaacctcagccagtcccagccagtccccgcggaaaaggaatttattgatgtgagacctgaacaatcaggaggagataaccaggcagaccagaagggagagaagatgcccagacagagaaagagacaggtgaaacgggtggcattcagagagctacaggtggttcagagtggctggagattgagtgaagggtgcagggtgtgcacacaccaggtnctgtggtttgcaatcttgatctttctgatgaagtgaccagagtttcgcctctgctgtgatcacaggtgtgattgaagagtcggttggcagtgtgccctgtgcctccccactcagggttcagtcctctgactcccgcctcctgtctccctcacctgttggccccaaaagggagtcactgttggaggcctgacatcagacatgccccctgggccgcacctcgggctcctgggactgccaagggtgagcagcctctccctggccccgcgagggagaaggccaatgaggagaaaggccacgggcatgctagaacccctcatgtgtgtgtgtgtg

SEQ ID NO: 262 - DNA, 661 bp, Homo sapiens
  misc_feature [331]..[331]: Chromosome 2, SNP identification no. = rs6753830
  misc_feature [331]..[331]: allele = t, in linkage disequilibrium with rs973128, respectively
  misc_feature [331]..[331]: n is a, t, c or g
aagatgcccagacagagaaagagacaggtgaaacgggtggcattcagagagctacaggtggttcagagtggctggagattgagtgaagggtgcagggtgtgcacacaccaggtgctgtggtttgcaatcttgatctttctgatgaagtgaccagagtttcgcctctgctgtgatcacaggtgtgattgaagagtcggttggcagtgtgccctgtgcctccccactcagggttcagtcctctgactcccgcctcctgtctccctcacctgttggccccaaaagggagtcactgttggaggcctgacatcagacatgccccctgggccgcacntcgggctcctgggactgccaagggtgagcagcctctccctggccccgcgagggagaaggccaatgaggagaaaggccacgggcatgctagaacccctcatgtgtgtgtgtgtgtgtgtgtgtgtgtgtgtgtcgttggtgtgagtgtgcatgaatagctgtgcacacataggaagtcaattgtcctttcccagttgagccgttgggaacattccccagaatttactcttcctccaaaatcattaccttatctcaggtggccctttggagcctttggcaccatagctgggtgaggcaggaagaaaaaaaacaagggcaggggagaagagga

SEQ ID NO: 263 - DNA, 661 bp, Homo sapiens
  misc_feature [331]..[331]: Chromosome 2, SNP identification no. = rs975951
  misc_feature [331]..[331]: allele = c, in linkage disequilibrium with rs973128, respectively
  misc_feature [331]..[331]: n is a, t, c or g
cctcacacggagctgcggggcctctgtgaggaagacagaaatgaaggcgatgagggtgttgagtttgaggcatccaagccacacggagggaagctggcatttgagaagagagggctggcgtgaaattcctactctcaggaagtggctgggggactttcagaagaggaatatttgaggttttcaagttaaagtggcagcctaaacacacatctaattgcatttttccccaaatctcactagaacaataatagagaactttaaaaggaagacataaaaccacaaaaatgagggaaacagaagaggagaaaacaggagcaaaacatgggaagcnggcagatgagcattctccgacgcagatggagaaagccagttcctaggccagcagtggggagagtttagaatcaaaaccatttacaagcaggatgcttagaagtctcaggaactgactctagagggaacctctctaagctgggtaaagaaggaagttgaaataaggatgggttgaaagttgtttaagaagcagtcagatgcctggaaaccctcctgtcccctccccttccccactggaaaattactgtgagtggttactgcccagaaggcaggaagattctgggtcatatgcctatggagaccccaccccggactctgactctaaacaccc

SEQ ID NO: 264 - DNA, 661 bp, Homo sapiens
  misc_feature [331]..[331]: Chromosome 2, SNP identification no. = rs973128
  misc_feature [331]..[331]: allele = c, g
  misc_feature [331]..[331]: n is a, t, c or g
aaggtctcaggagaactcactcactgtcatgaggacagcaccaagaggatggtgctaaaccattcaggagaaatccacccccataatctagtcacctcccaccaggccccacctccaacattggagattacaattcaacatgagatttgggcagagacacagacccaaaccacatcagagggtatgcaagataaagttgaagaaatctcctagaaatcaggaagaaaaaaaaaaaaaacaagagatggaaagtaggagagaagatttaaaatattggaggcttagcccaggagatctaatatggaaataacagaaattacagagaaaaaanagccaggcaagggatgaaaacaggcccatgccaagcatatctttgtgaaatttcaggcagctggggacaatggaattccacaagctttcagatggggcagaaaacaggtgacatgcaaaagatgaggactcggaatgattctgataactcatcagcagcgctgggacacaagaagacagcaaaggcaaacccaaaatgctggagggacacgctctccaagccgactcctctatccagccaaatactaattatgtatgaggctaaagacacttttagtcgtgcgatattgcaagaaaatttcctcccatgcaacatttctcaagaagctac

SEQ ID NO: 265 - DNA, 661 bp, Homo sapiens
  misc_feature [331]..[331]: Chromosome 2, SNP identification no. = rs875411
  misc_feature [331]..[331]: allele = t, in linkage disequilibrium with rs973128, respectively
  misc_feature [331]..[331]: n is a, t, c or g
ggacacgctctccaagccgactcctctatccagccaaatactaattatgtatgaggctaaagacacttttagtcgtgcgatattgcaagaaaatttcctcccatgcaacatttctcaagaagctactggagaatgtgctcctccaaactgagagttaacagaagggaagacacaggacataggaaacggcacagccagcatggagaggaggcaaggagcagtccgtaggagggtagtgcaggaggacagcactgcacaagacagggagggcagctggtccccgagggggtggcacaatgccagcaagaggtacatcgagggctgtcgcagngtcactgccaccggacagtctttccaacctgaggacaggaggctccggtgagcctggccccagttttgatttgcccttgccttgtcttgaccatgtgctgtgcagtctgtgcccacccctccttgcctgctgccacccccacctcagtgtgatctgccctgctcctgagaactggatgtgggccatagtgagcttagaaggaaaaaacaccaaacagctccctcctcttgccaggtgtccggtatctggctcacatcacagccctgcccgatgccttagttatagggagcctgtgtttccctaggctcactcatggtcttgtccagtgat

SEQ ID NO: 266 - DNA, 661 bp, Homo sapiens
  misc_feature [331]..[331]: Chromosome 2, SNP identification no. = rs875412
  misc_feature [331]..[331]: allele = g, in linkage disequilibrium with rs973128, respectively
  misc_feature [331]..[331]: n is a, t, c or g
caccgtcaagaattgggaaattcggtcgacccgtgaatatttgcacgggtgtgggtcgtaggacgaacgaaacccgtattgggtgtagactcagcaatcccaccgaaatttaagacgttacaataccctaatgtgaaaagacattataaacgtacttaaccgaacccagggatagtgtgtactccacttctagggttctacaaaagggaagggtacagaagtcccccagatcccctgtcactcaaaataagtccagagaagagagaagaaacgacacgaagacgaacaagagaagaacgagagacatgtcacagcgggaggtggtctgtgngggctccaggaaataagggatttcctgtggttactttccgactcacaactttagaccctcggtctttcaccccactcactatggtgttttgtcgtgtcgtctggtagagaaaaaagaaaattctaaaataacatcctatatagtgtgtgtcttttcacgtactttgtatttacatgtgaaatcgtttagcaatatttcatttctggatatattgtcagtgggttgacttctttatccgataacggtcgcgaggtcctgggagggtacacggggtgacatttgtcagaaatgtcactgtacaaagtatgtaagtcttctcacatattttgt

SEQ ID NO: 267 - DNA, 661 bp, Homo sapiens
  misc_feature [331]..[331]: Chromosome 2, SNP identification no. = rs6744463
  misc_feature [331]..[331]: allele = a, in linkage disequilibrium with rs973128, respectively
  misc_feature [331]..[331]: n is a, t, c or g
tcccctagaccccctgaagacatgggaagggaaaacatcttgggatcttcacctcatgtgtgatagggacccaagccaattcatgcaaatattacagaaaagtgtaatcccataacattgcagaatttaaagccaccctaacgactcagatgtgggttatgcccaaagcaagcaggatgctgggtgtgggcacgtttataagtgcccagctggcttaaagggttaagaactgccactctttgctaggattgcttttcccatcctttctgcctggtgagtttttctaagagtggtagggcttcactccagctagttttcacagaaaagcaanttattgaaaggcattttgaagctcatgggatctccaggagaccaaagagtcagacttggatgccacggagctaagaataatacctaagactcacagcagaggctgccccccgaccccagaaagctctgctccagtgtgaccccagaactctgccaccgttgccctgaagggccagagacctccgccaccccattctctatagaggaccccctacgagtctcacgtagggacattggtcataatgactgccccctgaggagggtggggagtgagttctggcttctaccttgattgggacagactcaaaatatggaaaattctccagtttgg

SEQ ID NO: 268 - DNA, 661 bp, Homo sapiens
  misc_feature [331]..[331]: Chromosome 2, SNP identification no. = rs2881879
  misc_feature [331]..[331]: allele = a, in linkage disequilibrium with rs973128, respectively
  misc_feature [331]..[331]: n is a, t, c or g
agagaagttgggctcccagtcacgggagcagctgcggccggttccagcagggggcagctctcaatgacagctgaagggcattgcatagccagatgcgcacatggcttttaggaactgggctctgcctcccctgaagtctgtctgaacctggggcatcaccgtctcaccgggctggggctttgatgcatcaggcccagagaaagaaacttggtagaggagaggaggaaggagatgcaaccttccaggaagcagaaatgttcaaggactctcaaaggaaactccagaaaacaaggagaggcaggaattgccttatgatcgcttctagctctangtctcacctttgaaataaagcatcttcctggtcccagtgcagagacaggtcctggggggaagcaggagaggagagaatcagctcctgttctcctgtctgcctcaacttccccaggcctacccagcccacctgggctaggacggaggtgctggcagcctctccccattaaccacaccctgcaggctgaggcgggcaggctgaggcgggcaggctgggggctgaggagacgctccttccctgcattccatggacatggtgccttgggccaggctgcagaggccgcagggcctggcatgtgccccgtgaaactggccctgcagtgaggcgggg

SEQ ID NO: 269 - DNA, 661 bp, Homo sapiens
  misc_feature [331]..[331]: Chromosome 2, SNP identification no. = rs4666362
  misc_feature [331]..[331]: allele = t, in linkage disequilibrium with rs973128, respectively
  misc_feature [331]..[331]: n is a, t, c or g
tcccagtgggaactcacactagacatgcgagggcagtcaaggagagcgctttcctcgctcgaggatatgggagagctttccaccctcctcctcaggccccggaggcagcgagtgtgcctgtcagggttatcagggtgctctgggaagggctccacctcccccgcaggcttcgccagaatgcccaactgggctgctctcactgcctttgaccttcagaactcccaaaatactcccacctcctccaggaagaaggcggggtagtgggggctttggagaccaataagccagggcctgactcctaactggccacctaatagctttgtgaccttgngcaagtgccctggtcttcctgagggcgtgttctcaagcttctccgttgtgtggttttagtgagggctggagatggcgacacgtagtagactctcaattcatggtggctcttattattaaagctggccaggatgtcccttctgacccccaaccctccagttcccatagtgctgggccttgtaactgtcactgtcctgtgtatggggtcaggctctggcctccctccctcgcaaccccttcggggcagggtgagagtaaacaggtcccctaggtgtgggacagacgcccgctgccctcctcctgccttattcattctctccaaaaacattaa

SEQ ID NO: 270 - DNA, 661 bp, Homo sapiens
  misc_feature [331]..[331]: Chromosome 2, SNP identification no. = rs6531212
  misc_feature [331]..[331]: allele = c, in linkage disequilibrium with rs973128, respectively
  misc_feature [331]..[331]: n is a, t, c or g
acaaactgtagggcacccgtatgatggaatgaccccagcaataaggaagaacaaaatagtaatacaatgaatgacatggatgactctcaaggcactgcgctgaagttcagcagttaaatgaaagccgcctaactcaaaaggctgcagactccgccgctccctgcgtctgaactccagggagggccacgctgcagccagaaagcaggtcagggcttgcctgaggtgggatgtgggagcggggattgattgcaatggggaatgagggaattttatggggggataaaaaaaatcaatgtttcatttgatggtaggtaggtggctatttccattnggcagagcttatcaaactgtatgcgtaaaacaagcaaattctacagtatgcaaactacaccataacgaagctggcagagtaaagaccttccagtttggaaactatgatctgggaagtgacccatattgcctggccagatacacgagggaagagtcatctccctaggaaacgcttaagaaaggctcagtccttaaaagaaataagaaactgagtgaccagaaaaaatgagggagaatttgaagaaatacagtaccagggcatcatagaagagctggctttaaatagactacagatagtgcactcaagtcttagtgcatttgtacgctgcct

SEQ ID NO: 271 - DNA, 661 bp, Homo sapiens
  misc_feature [331]..[331]: Chromosome 2, SNP identification no. = rs4666364
  misc_feature [331]..[331]: allele = g, in linkage disequilibrium with rs973128, respectively
  misc_feature [331]..[331]: n is a, t, c or g
agtaccagggcatcatagaagagctggctttaaatagactacagatagtgcactcaagtcttagtgcatttgtacgctgcctgaattacctgaccttggtcccttatctgatatcctcatccccccgggctctacctgaaaaaaaagctcacacgcatctttcataaataataagaagctatcctttaatgagatgatattttatctctcctggcccaggacggggaaggcgcccggcccctcttgagtcaccaggctcttatgcagtggagtttctctcctctgcttgcttccagagccttctgcaggctaccaagacaaagctttctcncattcctctgggcccggtccttctgctctctgctgctgccctctctgtccccattcctcctctgcctctggaatgatagcatctcccagtggctttcatgttggagtgctggctccttaacttaaggtcagcttctgagggcagaaggcttgtcccattttctctccttccctctgccctctcctttggaataaacgcacacattcaccaatgcagccattgactgtgtggctcgcccacactgttcaggagagaggcccagctccatctagcttgagcccaaaggaaatttattgggccacattcctgagaagtccaggacgtgtcagc

SEQ ID NO: 272 - DNA, 661 bp, Homo sapiens
  FSHR
  misc_feature [331]..[331]: Chromosome 2, SNP identification no. = rs3788981
  misc_feature [331]..[331]: allele = a, in linkage disequilibrium with rs1504175, respectively
  misc_feature [331]..[331]: n is a, t, c or g
gaggatggaagtaaaaaggagcaacggagacgtgagacgttcactacaagtgggagggagaggggtaatgaaagtacgaagaaggaaagaagagaaaggtgaaccagatcaacccttcttgggtgtctgtaatagtctctttacttggtttcccgtcggtcgggagacccgttccagttcgtccgtagggaactttgtaaagttacctgtcacttccatcaccaaacccagaaagtagagaaggaacgtatttctccacgagtggaggtacatcgtgactgacatgaattttactaattaacggaccatgaatctagacccatcgatgtcnaatgtcgttgtattttcgattactttgtccctccttcattgattgtctctcgtacagatgtttatgtgtaactaggtcgttctgttcctttcccgtccgacagacacaaccttaggtttacacttgtacgagtgaaggtctgacaactagttctgtgtcgtgttcggttttatcccgtcttcagtggggaaaggtactcgagactcactcgtcggagtcagatgacgtatttcccttagttaccggtaagggtcgatgacatacgaacctaaagtacgaattttcgtttttctatagctaacaaaaagagggttgaaagaaaaagaaacg

SEQ ID NO: 273 - DNA, 661 bp, Homo sapiens
  FSHR
  misc_feature [331]..[331]: Chromosome 2, SNP identification no. = rs9807991
  misc_feature [331]..[331]: allele = a, in linkage disequilibrium with rs1504175, respectively
  misc_feature [331]..[331]: n is a, t, c or g
gtacttttggaggctgagatgggtggatcacctgaggtcaggagtttgagaccagcctgagcaacatggtgaagcctgacctctactaaaaatacaaaattagtcatgcgtggtggtgcatgcctgtgctcccagctactcaggaggttgaggcaggagaatcacttgaacctgggaggagtttgcagtgagccgagactgtgcctaaactccagattttggtgagtaaataatatatccctgaaatgaataaaataaacaataaaaataaaagaataagaaatcaaaaacagaaacttctttttcactttctttctgatagaggagatanagtccccctctgggtctttcccatcttgtccctcctcccctgcctttctcttcacagagcatttttctccaatatatccaaaatatttctccctaactcagtaaattaagagactcaactgcattaaaatatttgtaatagtcactgaatcaaatttttcttttgttgttaataagctcaaactaaattcagttgactgttttccttccctgagtccccagtggttgaggatttccatagaccctctgttactgccccttgcatattgcattgggtttgcattctgctttgtttccctcactaggctaagaactgctggaggacagtgac

SEQ ID NO: 274 - DNA, 661 bp, Homo sapiens
  FSHR
  misc_feature [331]..[331]: Chromosome 2, SNP identification no. = rs10171892
  misc_feature [331]..[331]: allele = a, in linkage disequilibrium with rs1504175, respectively
  misc_feature [331]..[331]: n is a, t, c or g
cctttttgataccgtacctgtaacaaatggcttccccaaatggcttttctcctgcttccagcctctgttttcactctgtaatttataattactctattttttatgcccctccattttatacctctttaaatcttatcttggcttgaaagagcttcctttatgagccacagtgaaggagcaacaaggagctcacatttggctgcttttgtatttgagtcacactgatggtcttattttatcccttggaagccttgaatgtagcacccttatgagtgccctgcatgcaaagctgttatccatcctgccctttgcaacaattcagaaatttacnggtctgtattctctgactccatatttaactggttttatatccatttttgaacagtagttatcccccattctacccccaaattataggcaaaagccctactcctgcacctcctttgtctcctattggtcctgagactgtccgtgtttttacagtgaagggacctgcaaggtcaggaaaaggaaatggtttttaaatgcttcctattttatgagactaccaatgcctagagaaaaacgccatcattctagggaggaataagaagactggattattttttaacatgagtctttcatgttagtgatccagccagttaggccacccaagatattg

SEQ ID NO: 275 - DNA, 661 bp, Homo sapiens
  FSHR
  misc_feature [331]..[331]: Chromosome 2, SNP identification no. = rs10865238
  misc_feature [331]..[331]: allele = a, in linkage disequilibrium with rs1504175, respectively
  misc_feature [331]..[331]: n is a, t, c or g
tttgctgtttctgaaaagagacagcaagcctttttgcttagcctagcttctgagggtgacatgtcagggagctcctcctgccatacagaaatcatgaattatactagaaaatggaaattgtaattaggatgggcaggactgagaccctgtcttccttccagatacgtgcatatctattttaagatttccaagctgtatgaagaattattttagtcttcatgttatttgattgatggtcctagaggattttattttactatttctagattattctgaggaaggcccaagataggtcttgggtctttcaattctggaattggaagggaatccnaggagatctataccaggcaatgcattatttccttgagattatccccttgacatccttacctgaaaggaagaagacagactctctcagccttagggaacttccttcctttctcagcatcagacatttaaagaagtgaaaaaaaaaaagaaagcacactgaagaaatggtgcaatgatagtagcctaaagtaccttaaccaggctgggcacaatggctcatgccttttatcttagcatgttgggaggccaaggcaagcagattgcttgagcctaggagtttgagaccagcctggcaacatggtgggactgtgtctataagaaatacaaaaac

SEQ ID NO: 276 - DNA, 661 bp, Homo sapiens
  FSHR
  misc_feature [331]..[331]: Chromosome 2, SNP identification no. = rs12614817
  misc_feature [331]..[331]: allele = g, in linkage disequilibrium with rs1504175, respectively
  misc_feature [331]..[331]: n is a, t, c or g
tgacatagatctaactcccacgtctttcaactgctttggcaccaaagatctggacagcaacatttaggggttgcttatattctggtttatactctgttttacgtgaattccaatttctgtaactacattataaatttcttcggggttagaaccaaatcctatctgttcttttagctcctaatatggaagactggcagcgatgaatggatagctagattgataaaaacagcttaggagctactagtaagaatgaatatgagaatataagtgatatgctgtttttttctgattatataaagtcataaacagctgggggaaactcacattttcngttggtgaggagcacctattttgtttattactgtttcttccaggaaccctctcgccttcccaccttccctggttccttttatacaccacacttaaaattggaggcataaccttgttcaagcatgtgcaaaacgggaacatggtaatgaactcttattgctgctataaacttgatgaatggcttgtggaggaagggcattaaatggcaatctcagtccagtgattagctctgcagcattcctcctttggaactcatgcagaccagcacagatttcattctgctctaggtttcctgtgggctccatcaggtgtgcagaaatgctactgggcc

SEQ ID NO: 277 - DNA, 661 bp, Homo sapiens
  FSHR
  misc_feature [331]..[331]: Chromosome 2, SNP identification no. = rs3850344
  misc_feature [331]..[331]: allele = t, in linkage disequilibrium with rs1504175, respectively
  misc_feature [331]..[331]: n is a, t, c or g
gacacgtgaaagaggtatatcacaaaacaaaacacggtacaacggacagtagataattttctttaatctagaactctcagaatatcagtacagtcatgttttatcattcacacaggttcagacttcttttgttattgggaatttaaagacggttcatacattggaagtatacgtgtacaaaaacgagttataaagagtatgaagggtgagtcgcaactcgtgaaccgtgacccctttttttcctacaaaatcttcgcctacctacagattaggttcgtcatttttaggttcacgtttcgaccggaaaaggtgcggtttctcttttacgagnttattccacataggtaattatttttaactgggttcgacagggccgttttgtaaaaaaatttcttttaaaggattcagttgatctgaataaccgaaagaaaaaagaacaaaaacggatggagacagacggaagggaactttaattgtaagatcactgtacatctaagttggtcttggagaatcggttctaaagtagagacgttctctcctaaaaagaaaatcaatttaagttactcgtaaagtactcaaggacaagttacagaggatgtatttcgtgaagttttaaattacacgtatgtttagtgactcctagattgatgacacctctcag

SEQ ID NO: 278 - DNA, 661 bp, Homo sapiens
  FSHR
  misc_feature [331]..[331]: Chromosome 2, SNP identification no. = rs6716567
  misc_feature [331]..[331]: allele = g, in linkage disequilibrium with rs1504175, respectively
  misc_feature [331]..[331]: n is a, t, c or g
gggagattaatgagctaaggggtatatgaggcattttgaaattataaaataggatagccacatgaagatattcatactactactacaaattaaatggatgataactctgaatttgtgtttatgtacgtcctacttctctccattagggagcaaggttatcattgtcctacatcttatattatctgggctacacttttgcattcataaatatctcagaatagtagattaatgcatgaactttggagtaagaatgcctggatttaattcctggcttcatcacttatcaactgtgtgctgatgggcaagtcacataaccactttggcttcaacnttctcactataaaattagaatgatagtaagattcttatgatcagataagacaatgcatataaagtggcttagctcagtttctggcaaaataatcacacaacaaatggcagctgtgattaatgttgttgttaagcaatatgagaactccttgagtgcagggactgtgtatcttcatctttattgctcacagcatctatcagtgactaccaggtaagtttcatcaaatcatgtcctcatctaattagcacacattttgtagctcaagaagaatttgttgaatcattgattggtggacggattatgcttctcttagttggcttggtctctctt

SEQ ID NO: 279 - DNA, 661 bp, Homo sapiens
  FSHR
  misc_feature [331]..[331]: Chromosome 2, SNP identification no. = rs11125197
  misc_feature [331]..[331]: allele = c, in linkage disequilibrium with rs1504175, respectively
  misc_feature [331]..[331]: n is a, t, c or g
agcttatttattattattttttgagatggaatcttgctttgttgtccaggctggagtgcaatggcacaatctcagctcacggcaaactccgcctcccaggttcaagtgagtctcctgcctcagcctcccaagtaattgggtttacaggtgcccaccaccatacccagctattttattttttctgaatttttagtagagatgggctttcatcatgttggccaggctggtctcaaactcctgacctcaagtgatctgccagtcacagcctcccaaaatgctgggattacagatgtgagccatcgtggccagcctgtatagcttaaattgatanaatttttatatgtcaatcatacctcaagaagactggaaagaaaaagttgaggatgataaaaaaaaagtaaaataaataaaaagtggttttcttatagaaaaaaaacctggggctctgaaaagttgggaaaggaatcaagaggtagagactgcaaattaataaacatcacctgccattatcattccagtgtgcctaactctgtgctaggtgctttcgaggaatatgggaagagggaaagggcaggattagtagtcagcgtgtagtcagtcaagctgagacactataaatgggaaacagagcaaacatgctgtccttattattcataccttg

SEQ ID NO: 280 - DNA, 661 bp, Homo sapiens
  FSHR
  misc_feature [331]..[331]: Chromosome 2, SNP identification no. = rs13004879
  misc_feature [331]..[331]: allele = g, in linkage disequilibrium with rs1504175, respectively
  misc_feature [331]..[331]: n is a, t, c or g
tgtgcctaactctgtgctaggtgctttcgaggaatatgggaagagggaaagggcaggattagtagtcagcgtgtagtcagtcaagctgagacactataaatgggaaacagagcaaacatgctgtccttattattcataccttgcatttgcactcacttttaacttttcaaagcatgctcacgtccaagtgcatattacgtgtttataaaacatttggcataaacaattgctatctctctgcccagactctctcagaacctcagacccactgggatggctaacttctgcttcattcatttaggcttctctagcatttacccctagctcctgnacttttcctctctgcctgcttaacttctggaatggttatatataaaaacacatctttggtcatttgattgctgtgtaggctggccagggtgaatctgagcactgcaggggaggtttatgaagtgtaagattcaggtaatttatttgttggaaggtggacaggcaagagggtccatattctatttgaatcttttactgtttaaagcatcttattaagtcatacacagcccagatggatgtggttgtgatgggcatgggctaaatgaggaaataaaaataaatagttcatgcattgattgcagcttacctttagattgcttctttttatttt

SEQ ID NO: 281 - DNA, 661 bp, Homo sapiens
  FSHR
  misc_feature [331]..[331]: Chromosome 2, SNP identification no. = rs3913665
  misc_feature [331]..[331]: allele = a, in linkage disequilibrium with rs1504175, respectively
  misc_feature [331]..[331]: n is a, t, c or g
ggtccacgattctatactgtctccaatgagttccgtaaagactgaacgatagtttgcgttagaagaaggtaaaagattagttgtcggttcactccagtagaatagatagaaaatgttgaagacgaagtcgttgtgaaagggaaacctgagaggaactgtttcgttcgacacacactctggaaggtcacttaatataaacagtcacgagtctctatatggtcttttacttaaccggaaaaaaaaaaggaggaacgaccattgagttacaaaaacagataggtcacttctatgttaattccgtcgtattatgagctcaatttttataggaacnccgagacgagacccctaaaaagatcgaaaaaaaaaattatctaccacaattttatttttcttcgttagatttccattcgacgttagttacgtacttgataaataaaaataaaggagtaaatcgggtacgggtagtgttggtgtaggtagacccgacacatactgaattattctacgaaatttgtcattttctaagtttatcttatacctgggagaacggacaggtggaaggttgtttatttaatggacttagaatgtgaagtatttggaggggacgtcacgagtctaagtgggaccggtcggatgtgtcgttagtttactggtttctaca

SEQ ID NO: 282 - DNA, 661 bp, Homo sapiens
  FSHR
  misc_feature [331]..[331]: Chromosome 2, SNP identification no. = rs1504175
  misc_feature [331]..[331]: allele = a, g
  misc_feature [331]..[331]: n is a, t, c or g
gaggtttccttcactctgtgactataggagtagagaatcactctaggttctggtttgtggcagttccaagggcttaggcacagacatcctctcctctgataataaatgtcaccaaaggaagctaatagctttaattttcctgtcaatccctcttttaccttagcaggaacatgtgggaaaatggtagattccaactaaaagaagccttgtgtagcagaaaggaccagactaccttgggtttaaatcctagcttcaccacataaggatactctgatgttgcttggtttcttaccttttgtgaatgtcagtatccctgtctatacagtgtganttaactgagatgtagtatttaaaacacctgtcccagaataggtgtggaataattgctgattttaaaaatcaactttgttgaagtataatttgacaaataataaaatgcattcattttaactcttccacctgttactactaccacaatcaagatataaaatatcttcaccacgttaaaaaagtttccttgtctgccttcccagacaatccctaacaccaccctgggaaccaggcaactaatctttctgttaccatagattagattttcttcttttttgaggttcatataaatagaatcatatggtataccttctgtgtctggcttctttgc

SEQ ID NO: 283 - DNA, 661 bp, Homo sapiens
  FSHR
  misc_feature [331]..[331]: Chromosome 2, SNP identification no. = rs1504177
  misc_feature [331]..[331]: allele = c, in linkage disequilibrium with rs1504175, respectively
  misc_feature [331]..[331]: n is a, t, c or g
ggaccagactaccttgggtttaaatcctagcttcaccacataaggatactctgatgttgcttggtttcttaccttttgtgaatgtcagtatccctgtctatacagtgtgagttaactgagatgtagtatttaaaacacctgtcccagaataggtgtggaataattgctgattttaaaaatcaactttgttgaagtataatttgacaaataataaaatgcattcattttaactcttccacctgttactactaccacaatcaagatataaaatatcttcaccacgttaaaaaagtttccttgtctgccttcccagacaatccctaacaccacnctgggaaccaggcaactaatctttctgttaccatagattagattttcttcttttttgaggttcatataaatagaatcatatggtataccttctgtgtctggcttctttgcttactataatgcttttgagagatttatccatgttgttttacatattagcagtgtattcttttttattactgcttagtattaaattgtgtggatatcataccatttgtttacccattggcctgctgatggacatttgagtgattttctgtttggggctattatgaataaatctgttatgaacattcttgcagtctctgtgtagaaatatatgtatttattt

SEQ ID NO: 284 - DNA, 661 bp, Homo sapiens
  FSHR
  misc_feature [331]..[331]: Chromosome 2, SNP identification no. = rs2134811
  misc_feature [331]..[331]: allele = g, in linkage disequilibrium with rs1504175, respectively
  misc_feature [331]..[331]: n is a, t, c or g
ttcagatattttgcccattttaaattagattgtgtgtctacttattttttacttctttatatatagaaagatatgttcttgatacaagtcctttttcagatatatgtattgcagatattttctctcattatgtgatttggttgtcattttcttgatggtgtctttttttactttttttattgtcttttgaaaagcagaagttttttcttttaatgaagtccaaaataacacttttattttatgcttaatgtgttctacttaaggaatctttgcctatcccctgattgtaaaatatttttctcctaacagttttaaaattttagtttttgcntttaagtcaattatccacttaaagttaaattttgtgtataacatgaggtaagggttgggatttattgtttttccaatatggatacaaagttgattcagcatcatttgtggaaaaaaactattctttccgtattgaattctagaaaacaaacacttttgggatatagatgatgagagaacatttcccaactcattttataatacaggtagaacaaaatcaaacaaagaaacgacaagaaaataaatatacagactaatattgctacaaatatagataaaacattttaaacaaaatattagcaaatcaaaatttgtgtgtatggacaatttt

SEQ ID NO: 285 - DNA, 661 bp, Homo sapiens
  FSHR
  misc_feature [331]..[331]: Chromosome 2, SNP identification no. = rs13032266
  misc_feature [331]..[331]: allele = g, in linkage disequilibrium with rs1504175, respectively
  misc_feature [331]..[331]: n is a, t, c or g
caaagaaacgacaagaaaataaatatacagactaatattgctacaaatatagataaaacattttaaacaaaatattagcaaatcaaaatttgtgtgtatggacaatttttaacaaatgcaaatcagattatgtcactttgttgctcaaaacaccccatttaatcccaatcacactaaatatgacacccaaatacatccccatggtctatcaggtactaatatgacctcactcccagcttcctctttgatcttatgtcctgccaacctcctctttgttttattcttctttagctacaacatgtagatgatacactttacatactcatgaatnttctttgtacaaattggattctgactaaactatcatctacctcagtggctttcaattttagatgtacattagaatcatcaagggagctttaaaaaatgattaatgcttagacctcgtcctggaaaaatggaataaaaatatctggaagtgatacttgggtgtgtacattatttttaaagttctccaggggattctaaagtgcagtctaagaagagaaccactcaacgtcatttccttgttattcccagggactcaaatcccctcttcccattcagagatctaaccagtctaacactggcctttcatttttcaccaggagccagtagaatc

SEQ ID NO: 286 - DNA, 661 bp, Homo sapiens
  FSHR
  misc_feature [331]..[331]: Chromosome 2, SNP identification no. = rs1504188
  misc_feature [331]..[331]: allele = c, in linkage disequilibrium with rs1504175, respectively
  misc_feature [331]..[331]: n is a, t, c or g
tttacatactcatgaatgttctttgtacaaattggattctgactaaactatcatctacctcagtggctttcaattttagatgtacattagaatcatcaagggagctttaaaaaatgattaatgcttagacctcgtcctggaaaaatggaataaaaatatctggaagtgatacttgggtgtgtacattatttttaaagttctccaggggattctaaagtgcagtctaagaagagaaccactcaacgtcatttccttgttattcccagggactcaaatcccctcttcccattcagagatctaaccagtctaacactggcctttcatttttcancaggagccagtagaatcatcagcctctccttttcgctttgagtaagcgggactcaaggctgctttgaccattaactctcagaatcacagaaggttgggttaggaaggaacttaagtcatgtaacaagggggtgctctgaagggcaaagctgagtggaacccaaattttctagcactgttgcagttacagttctggttacctgatttacttcctttccttttatctgtgctgagtgagcctgaagaactgagaattgggaggatcctcaacttttttaatgtgtttgcaacaattctcattcaataaatctctttctctaaaagtccctct

SEQ ID NO: 287 - DNA, 661 bp, Homo sapiens
  FSHR
  misc_feature [331]..[331]: Chromosome 2, SNP identification no. = rs1504190
  misc_feature [331]..[331]: allele = c, in linkage disequilibrium with rs1504175, respectively
  misc_feature [331]..[331]: n is a, t, c or g
ctggttacctgatttacttcctttccttttatctgtgctgagtgagcctgaagaactgagaattgggaggatcctcaacttttttaatgtgtttgcaacaattctcattcaataaatctctttctctaaaagtccctctgttaagttaacttttctttccccagtgatctgggggtggaggctggagtgtcagactagtgttctcatttctatatgcaaataaatcacttgattatattttttgtccttatgttatcatgaatatttcaaatgaattttatgtggttcatatttatggtttgggagctatttcacattttggcttattgcngcctcatctgcatataccatatttcagctgatgttgattggtctcatttgcatattcatcatgctcctatttccaaagatattttgttataaactagctttccccccacctccagtgttataataacacatagatgtgtttttaaattgaactcatttccatacataatttttctggttaccataaatcaccacattgtcacctactccccccaccctattcaatgtaatcttcacactttataccaagctgacatatggctccgaagtaattaaagacaatgtaaacagtttacagtgcactttgcaaagccacttcatgttgcagaga

SEQ ID NO: 288 - DNA, 661 bp, Homo sapiens
  FSHR
  misc_feature [331]..[331]: Chromosome 2, SNP identification no. = rs2091786
  misc_feature [331]..[331]: allele = c, in linkage disequilibrium with rs1504175, respectively
  misc_feature [331]..[331]: n is a, t, c or g
ggacaataaacaagtctcaaaaaaattttaaaaatatcaaaattatgtcaagtaccctataataccataatggaataaacctagaaatcaataacaagagaaacatttgaaagcatacactacatggaaattaaacagcacatttctgaataatcaatgggtaaagaggaaattaagaataaaatttaaatctttcttaaatgaaaatgaaaacacaaaataccaaaacctatgggatgagcaaaagcagaattaagaggcaagtttatatcagtaaacccctatatgaaaaaacaagaaagatttcccagcctcaaataaaccaattaanactgcaactcaaggaactaaaaaaggaagaacaaaccaaaccaaaaattagtagaagacaaaaataataaatatcagagcagaaataaatgaaattaacactaaaataataacacaagagatcaatgaaataaaaagttgcttttctgaaatgataagccaaatgaacaaaccattagctagactaagaaaaaatgggagaataaccaaataaataaaatcagaaatgaaaaacatacacaatgacagtagcagtagtagtaacattacaatgtttactaaaaaaatacaaaggatcattaaagattgctatgaacaagtatacaccaat

SEQ ID NO: 289 - DNA, 661 bp, Homo sapiens
  FSHR
  misc_feature [331]..[331]: Chromosome 2, SNP identification no. = rs1394207
  misc_feature [331]..[331]: allele = c, in linkage disequilibrium with rs1504175, respectively
  misc_feature [331]..[331]: n is a, t, c or g
tatgggtcaccgtagagggtcctctactccgtgaaacgtcatcactggtatctgggaccttaccaccccgaatcgtcgtaagatctgagaaatgtcggtacacatcgttgtcgttcatagggtcttaccgtttcgtgtcgagatcaaacccggccccccctcacccatgtacctactgacgtgaggggtccctctctccatagagtcttcgggtcttatcccttgatcaggccgaggtcccttcgttccatgatctccataaaccgtatatcccacctcataaagtcaagtcggtgaagagagaacggacccgccgtcctatgatattgtngagtcggaaccttatacgtcgacaagtcgaaccggtcccgtaactgaagggtccccgttacacggtgaagtcgagtccggacaccctacactgacaagatccgtcgggttcggggtaaagggaccttacgtctcacagtgtagtcgaatccatgaccccacacactggtgggaccgaccagttccgtagtaaaggaccctacgtcccgtgtcaaagttgaatccgtgacctctccgtactgaagagactcaccagttccattacaaaagggtcctatgactcaaaaacaaaaacaaaaaaaaaggaaaacgattatggattaccctagta

SEQ ID NO: 290 - DNA, 661 bp, Homo sapiens
  FSHR
  misc_feature [331]..[331]: Chromosome 2, SNP identification no. = rs4420736
  misc_feature [331]..[331]: allele = c, in linkage disequilibrium with rs1504175, respectively
  misc_feature [331]..[331]: n is a, t, c or g
tacctaagctgatgtgacactctgcattccagggaaatggggcttgggctgcctagaacagtcacatcccacaggcctgagctgaagtggcacattgcccctgggaagtcaatgccctggccaagctgaacagctgcatattccaaggctgagctgttatagtatcctgccgcccaggcaagagagaagtggctgaactgaaatactccaccctatatgccaaatacctctagtaccttgcttccctggagccggactagttccctattctgggcttctgagatacctctctccctggggagtgcagtcatccatgtacccactccccccnggcccaaactagagctgtgctttgccattctgggatacttgctgttgctacacatggctgtaaagagtctagaatgctgctaagccccaccattccagggtctatggtcactactgcaaagtgcctcatctcctgggagatgccactgggtatatttggctcaggttctcaaattgcatccatacctttctccccctgcccatacctccagattaccccttcttctgagggatcaaggtagtactgtaccttgctcctcaggggcataatcaccactacaacgtggcaccttgaacccaagctgctagggggtgcctcagagtcacaaat

SEQ ID NO: 291 - DNA, 661 bp, Homo sapiens
  FSHR
  misc_feature [331]..[331]: Chromosome 2, SNP identification no. = rs11686474
  misc_feature [331]..[331]: allele = t, in linkage disequilibrium with rs1504175, respectively
  misc_feature [331]..[331]: n is a, t, c or g
gcattccagggaaatggggcttgggctgcctagaacagtcacatcccacaggcctgagctgaagtggcacattgcccctgggaagtcaatgccctggccaagctgaacagctgcatattccaaggctgagctgttatagtatcctgccgcccaggcaagagagaagtggctgaactgaaatactccaccctatatgccaaatacctctagtaccttgcttccctggagccggactagttccctattctgggcttctgagatacctctctccctggggagtgcagtcatccatgtacccactcccccccggcccaaactagagctgtgcttngccattctgggatacttgctgttgctacacatggctgtaaagagtctagaatgctgctaagccccaccattccagggtctatggtcactactgcaaagtgcctcatctcctgggagatgccactgggtatatttggctcaggttctcaaattgcatccatacctttctccccctgcccatacctccagattaccccttcttctgagggatcaaggtagtactgtaccttgctcctcaggggcataatcaccactacaacgtggcaccttgaacccaagctgctagggggtgcctcagagtcacaaatcttggcttcatgggaaacctaca

SEQ ID NO: 292 - DNA, 661 bp, Homo sapiens
  FSHR
  misc_feature [331]..[331]: Chromosome 2, SNP identification no. = rs11680730
  misc_feature [331]..[331]: allele = g, in linkage disequilibrium with rs1504175, respectively
  misc_feature [331]..[331]: n is a, t, c or g
ctgggaagtcaatgccctggccaagctgaacagctgcatattccaaggctgagctgttatagtatcctgccgcccaggcaagagagaagtggctgaactgaaatactccaccctatatgccaaatacctctagtaccttgcttccctggagccggactagttccctattctgggcttctgagatacctctctccctggggagtgcagtcatccatgtacccactcccccccggcccaaactagagctgtgctttgccattctgggatacttgctgttgctacacatggctgtaaagagtctagaatgctgctaagccccaccattccaggntctatggtcactactgcaaagtgcctcatctcctgggagatgccactgggtatatttggctcaggttctcaaattgcatccatacctttctccccctgcccatacctccagattaccccttcttctgagggatcaaggtagtactgtaccttgctcctcaggggcataatcaccactacaacgtggcaccttgaacccaagctgctagggggtgcctcagagtcacaaatcttggcttcatgggaaacctacatctaatcctgccaaggagagcaaacttgcacctcaagacccaggtgccataacaggtatgcaagaccataagcctgg

SEQ ID NO: 293 - DNA, 661 bp, Homo sapiens
  FSHR
  misc_feature [331]..[331]: Chromosome 2, SNP identification no. = rs11676909
  misc_feature [331]..[331]: allele = a, in linkage disequilibrium with rs1504175, respectively
  misc_feature [331]..[331]: n is a, t, c or g
taaccaagggatctgagaaactgtaaattctgagtacagtctgataaatgtgctgttaatattatgaatacagggttatggtttggaagaacttggaaagttctggaaaagttctgtagaaaagtaagcatttcatctggtccctgaatgggaagcaggattttatgaagtgaaattttagacagagggacagcatctacataagaacagtgtgaaagtatattttgttcatttgtttatttgttgattcattcccctgcaattatttttgatccctttatgtgccagacattgtccaaagaacaagctgtcacattctaaatatgcaatntgatgtctggtaataatagtgcttggggaatagaaaattattccacctggtgagagtgtaaggtacacagtgcatatggtgggaaataaagggttttgatttctgtgccaggagcttatgacttaagtctgcagcgaggaagatccctagaagttcttctgcaagagaatttaaacagtgcaagtctggcagcagagtggcaggaagattggagctgggataggcatggaagcttcatacagtaggttatgtaagtgatgatgagactttgggtctaatagtaacaggaatgagaagaggactggatatcagagtacatctgagaggcag

SEQ ID NO: 294 - DNA, 661 bp, Homo sapiens
  FSHR
  misc_feature [331]..[331]: Chromosome 2, SNP identification no. = rs12473815
  misc_feature [331]..[331]: allele = c, in linkage disequilibrium with rs1504175, respectively
  misc_feature [331]..[331]: n is a, t, c or g
tctggtccctgaatgggaagcaggattttatgaagtgaaattttagacagagggacagcatctacataagaacagtgtgaaagtatattttgttcatttgtttatttgttgattcattcccctgcaattatttttgatccctttatgtgccagacattgtccaaagaacaagctgtcacattctaaatatgcaatatgatgtctggtaataatagtgcttggggaatagaaaattattccacctggtgagagtgtaaggtacacagtgcatatggtgggaaataaagggttttgatttctgtgccaggagcttatgacttaagtctgcagngaggaagatccctagaagttcttctgcaagagaatttaaacagtgcaagtctggcagcagagtggcaggaagattggagctgggataggcatggaagcttcatacagtaggttatgtaagtgatgatgagactttgggtctaatagtaacaggaatgagaagaggactggatatcagagtacatctgagaggcagtcagtaggactggaggagcaccttggcataagggatagagaatgcacctgagtcaagggagactggattttccttgtttgggaacctgggcagatggtgacatgattcactgggcaatatgggaatacgagaaat

SEQ ID NO: 295 - DNA, 661 bp, Homo sapiens
  FSHR
  misc_feature [331]..[331]: Chromosome 2, SNP identification no. = rs11125206
  misc_feature [331]..[331]: allele = c, in linkage disequilibrium with rs1504175, respectively
  misc_feature [331]..[331]: n is a, t, c or g
tctgcagcgaggaagatccctagaagttcttctgcaagagaatttaaacagtgcaagtctggcagcagagtggcaggaagattggagctgggataggcatggaagcttcatacagtaggttatgtaagtgatgatgagactttgggtctaatagtaacaggaatgagaagaggactggatatcagagtacatctgagaggcagtcagtaggactggaggagcaccttggcataagggatagagaatgcacctgagtcaagggagactggattttccttgtttgggaacctgggcagatggtgacatgattcactgggcaatatgggaatangagaaatttaaaaataaagataagctagttctgaatatgttgaattccaggtatttgcagttcactcagatgtagatgtttaggcatctttccaattcaaaacaagaattatggcctcaggagagaggtggaggttgcagatgaaagtttaggaaccctggtaataagacattatctgacaactggtcattcaagggtggagctagaagaaaagaaaatggccaaaaaatagaaccctagaatacctaaatttttgaagggcagttgaagaacaagagagatgaagagaactggatatggagcaatctgggaggttaatagggaggcagg

SEQ ID NO: 296 - DNA, 661 bp, Homo sapiens
  FSHR
  misc_feature [331]..[331]: Chromosome 2, SNP identification no. = rs1882560
  misc_feature [331]..[331]: allele = c, in linkage disequilibrium with rs1504175, respectively
  misc_feature [331]..[331]: n is a, t, c or g
attttaactagaacaaaaaaatgggaaaaatatggtattccgaagtttcgtaaaagatcgtctcccgggtcgtgacttgacttggactcctctgaacgcataaggagtcagaggcacgagtggaaacaggtaacagaatggaatgtgagaaccagtggttctttaagagtagaggaaaggtctggatagaggaagtgaacacaagaaggtcaacaattagtcaaaggacttgaattatttataaccggaaaagaagtcatagagggggaggtgtttagtgtttcaggaaaagtaagtaagacgtgtacactggttgaaagtggataggtanaacctttcttattttcttttcataagacatatttaaggtggaaggataagacgagggaagaagagagaaggggtagttctggtgacacaactttctcaacggatgtaagtgacggagagataggaaagaaaagttagcgaagaatcggacgggtgaacgataaacctgtttttaagaagttgtgataatttaataagatagtttctagagtttttatggtgtcaatgttctaggtcacttaagatgaaataggagaagatgaatggaatatacatcagaaatttaaagtaattggtaattacagtaagaagagttacgggaaaggggtga

SEQ ID NO: 297 - DNA, 661 bp, Homo sapiens
  FSHR
  misc_feature [331]..[331]: Chromosome 2, SNP identification no. = rs12620805
  misc_feature [331]..[331]: allele = g, in linkage disequilibrium with rs1504175, respectively
  misc_feature [331]..[331]: n is a, t, c or g
aggtaagacaatggacaaaggtgagcacggagactgaggaatacgcaagtctcctcaggttcagttcagtgctgggccctctgctagaaaatgctttgaagccttatggtataaaaagggtaaaaaaacaagatcaattttattttggtgtatcgctgtgccagttcaggatgattaatgaagacatgaggtaaaaatgtacaagctgtgtctgaacaagttgagttactgagccagctgctgtggttcttggattgttgatatgtcagctcagctcaaccattcgtattgccacaggaaggtttgcctgatactgaatacccaatgaggngtcattcacacttgctggattaaacttgattaaagtagcttatttgtgacatctgaaatgcctgtctttagaattctatgtaattatagtgatgtttagggacacagggatatccagtagtcatttagtctatgttagctccaggcaagggaatcgcgaatacatcttgagcataaagctctcccactctactgtctccctggtttcctttgtgaactctgttcagctttagtatccccatcttctaatccctgtgatagttgaatgtcctcaatgaggtaaacccggaagattacaggtcttaaatcgggctctcctgcaacatggaga

SEQ ID NO: 298 - DNA, 661 bp, Homo sapiens
  FSHR
  misc_feature [331]..[331]: Chromosome 2, SNP identification no. = rs11903014
  misc_feature [331]..[331]: allele = a, in linkage disequilibrium with rs1504175, respectively
  misc_feature [331]..[331]: n is a, t, c or g
gtcatttagtctatgttagctccaggcaagggaatcgcgaatacatcttgagcataaagctctcccactctactgtctccctggtttcctttgtgaactctgttcagctttagtatccccatcttctaatccctgtgatagttgaatgtcctcaatgaggtaaacccggaagattacaggtcttaaatcgggctctcctgcaacatggagatagaaattggaaatcacgtaagcccctttttaaaactcctctcttaatacacagatgaggaaaccagggccctgaaagataaaatgctttaatcgaggttatgcagtaattttatattanaactagcactgaaaccaggattctgaccaccctcttttaagcaggtggcttaattgctggaacataatgacatcttctatactttgtgattcttttgttattggattcctttcttgcttcttcagacttcaggaagtactattcttaaagggatataaaagaaccaaaaagataaagttaatgacttcaagaaagaaacacatgaactaaaggttttctttcttgccttgctttcattcccttctgtatatactctgtctattcattgctatacttactggcattaaagtcctgaatcctggctgtctcactgcagagaagaacatattt

SEQ ID NO: 299 - DNA, 661 bp, Homo sapiens
  FSHR
  misc_feature [331]..[331]: Chromosome 2, SNP identification no. = rs6716923
  misc_feature [331]..[331]: allele = t, in linkage disequilibrium with rs1504175, respectively
  misc_feature [331]..[331]: n is a, t, c or g
ttcatttgcagtatctaatataatcttcaaaatcatcttgtgaaataggtaactatccatacttgtgtccacttatagatgagggccctgagctgagcatggtttatttacttgatcaaggacacagttagaaagtggcagatgtagttctgaagcctgtctggtcccaaagcccatgcgcacaagtctgcgtgtgtatgtggtgcagagggataagagaatgggacccagggctggtaaagttttaatgagggcgaggagaatgagtgataacaaaacagttctggagcttagatgtttctttaaaaagtaggaccaggtaagaaaattnaaaaaaagacagcagtcatgcgaggttgtgctgggactttgaggaaacacaaagatgccccaagaaggggaaagaagaaattttaccagaaattcttcagaaagacagtctggtataaaattaattcagaattgaacttttgttactctagattctgcaccccggttgggataattcagtgatgcccttacttttgctctgtcagtgtgggtaaacagaattcgactttaatgattcactgtagtttcaggcagaatgacaaacgcattgtgcctctaaagcagttctttaggtgccctcagttaatatccacctgatttaactgtgaat

SEQ ID NO: 300 - DNA, 661 bp, Homo sapiens
  FSHR
  misc_feature [331]..[331]: Chromosome 2, SNP identification no. = rs976230
  misc_feature [331]..[331]: allele = g, in linkage disequilibrium with rs1504175, respectively
  misc_feature [331]..[331]: n is a, t, c or g
caatcttcctacctggatgagatgcatgcatgcagcacccatcctgtggtcgtgaagatggaagacaaatactaagtaaaagtggagcagagagagggatagatcccagatccctgatcagatccttaaatagttagctctggctgtctacagccgggccttttgttatgtaagaagaatgtagcactatcaatctaaatcattattattctaggtttctatcacttgtacctgaaggcaattccaactgatacattgagagagtatttatagtgaaagaagcactgaggaaagctgacccaaaggaagggaccagggaagaaaaccaggnaaggagattgagaaagaatgatcagggagcttcaaggagaactggaaagtgttgtgttaagaaatcaaaggaagtagagaatttttaaaagcctagtgataaaaatggcaagtgcatcaaagagatgtaataagataaaaactgaaacatatgcaatggtgtaatcattgagaggtcattggtgactttattagaaaaaatttctgtgcattgttggggaagacatttgattgcactgtattgaggaaagatgtggaaaagttaaggaaataaaaacagcaaatgtaaaataaccttccaaaaattttggatgaaccagggaagagatgt

SEQ ID NO: 301 - DNA, 661 bp, Homo sapiens
  FSHR
  misc_feature [331]..[331]: Chromosome 2, SNP identification no. = rs11898430
  misc_feature [331]..[331]: allele = c, in linkage disequilibrium with rs1504175, respectively
  misc_feature [331]..[331]: n is a, t, c or g
agagggatagatcccagatccctgatcagatccttaaatagttagctctggctgtctacagccgggccttttgttatgtaagaagaatgtagcactatcaatctaaatcattattattctaggtttctatcacttgtacctgaaggcaattccaactgatacattgagagagtatttatagtgaaagaagcactgaggaaagctgacccaaaggaagggaccagggaagaaaaccagggaaggagattgagaaagaatgatcagggagcttcaaggagaactggaaagtgttgtgttaagaaatcaaaggaagtagagaatttttaaaagnctagtgataaaaatggcaagtgcatcaaagagatgtaataagataaaaactgaaacatatgcaatggtgtaatcattgagaggtcattggtgactttattagaaaaaatttctgtgcattgttggggaagacatttgattgcactgtattgaggaaagatgtggaaaagttaaggaaataaaaacagcaaatgtaaaataaccttccaaaaattttggatgaaccagggaagagatgttggagggtagctagagggagagaaagtcaaagaaaaactttatttcctgcccagttgtgagagactcaaacatgtttataggctgggaaaga

SEQ ID NO: 302 - DNA, 661 bp, Homo sapiens
  FSHR
  misc_feature [331]..[331]: Chromosome 2, SNP identification no. = rs974896
  misc_feature [331]..[331]: allele = g, in linkage disequilibrium with rs1504175, respectively
  misc_feature [331]..[331]: n is a, t, c or g
gtcataagacaagatttagaaacaaacgtaaggcctatttcaggtagaactacagaggcctcctctgcttgtcttcttccaagccaagaactcagaatttgccttgcagaaccccttgtgcatagttgtgatcctcagcacagatctaggggcagggggcagccaataactgacatccaaggatgtcaaagggcacattctgagatggcatccctacagaaccgatggcctgcctctaacggctggctcattggtacagtgaggacctatccctatcttttaaattgagggcaaaaatggcaggaaagagaggggaaaagtctctaaagantgtatctgattctcttggccttactggaataacctacataagggtcagggttttcctctcatgatgttcagggataagaaagactacagtcatgactctatctatgccctggatgaaatttgggataaagacagatcattttattgcattgtgaatagaggacaacaggtgctttgtttggttttcttttagtgtgccttgctgccccattggttttccccaaagctcaaatgtcatggattattgtgactaggtgggctatgttttttttttttatcctctaaaaagacattgaaagaattcactattatcactgcaatttcagtttgt

SEQ ID NO: 303 - DNA, 661 bp, Homo sapiens
  FSHR
  misc_feature [331]..[331]: Chromosome 2, SNP identification no. = rs974897
  misc_feature [331]..[331]: allele = a, in linkage disequilibrium with rs1504175, respectively
  misc_feature [331]..[331]: n is a, t, c or g
ccaagaactcagaatttgccttgcagaaccccttgtgcatagttgtgatcctcagcacagatctaggggcagggggcagccaataactgacatccaaggatgtcaaagggcacattctgagatggcatccctacagaaccgatggcctgcctctaacggctggctcattggtacagtgaggacctatccctatcttttaaattgagggcaaaaatggcaggaaagagaggggaaaagtctctaaagagtgtatctgattctcttggccttactggaataacctacataagggtcagggttttcctctcatgatgttcagggataagaaagnctacagtcatgactctatctatgccctggatgaaatttgggataaagacagatcattttattgcattgtgaatagaggacaacaggtgctttgtttggttttcttttagtgtgccttgctgccccattggttttccccaaagctcaaatgtcatggattattgtgactaggtgggctatgttttttttttttatcctctaaaaagacattgaaagaattcactattatcactgcaatttcagtttgtaaaggcttgggggagatgatagtatcagtaatcatgccagtaagagtataggaaaggtcattatctagcaaactcttacctgg

SEQ ID NO: 304 - DNA, 661 bp, Homo sapiens
  FSHR
  misc_feature [331]..[331]: Chromosome 2, SNP identification no. = rs4510264
  misc_feature [331]..[331]: allele = a, in linkage disequilibrium with rs1504175, respectively
  misc_feature [331]..[331]: n is a, t, c or g
aggtgagggttccaaggaagcttactttaagtttcttaatgccttagaaagtcaggcccctccccttttgtgcttaaaaaacaaaggttggcaattaaacttcaagagtcgtgaggctgggcaaaaataaatggaaaagatttaaatgagaaaaacaactaagtttctgctttctcagaaagatcaggctctgcaagctgattctcatcaatgtgccctgttggctctcatttcccaaaggcccatcccagtctccacattgatacattcagtctttcaggacaaagcagtgctgtctttgtgagccgtgctctactgccagctgcctgcnagctgccccactcaaggccactgagcagacaaacaaagctttaggaagaggtgcatctggatgttttgacctctctccaccatgtgaggctggctgtatgttccaagttgatggaagttgaagaacactgactcagacaagagtttcatggcaaggtgagggttctcctcatccctcccaatcagcaagctagaccttactcccaaaagcaaactgggcagtcataagaaaatcactcaatccctctggatctcagttttctcctctgtaaaatgggcatatgactatctgctctgccttctgagcagcttattaggaaggccaaaggag

SEQ ID NO: 305 - DNA, 661 bp, Homo sapiens
  FSHR
  misc_feature [331]..[331]: Chromosome 2, SNP identification no. = rs9309159
  misc_feature [331]..[331]: allele = a, in linkage disequilibrium with rs1504175, respectively
  misc_feature [331]..[331]: n is a, t, c or g
tatgaaaaataaaaagagtaagaaccctcgtagcattactgtggtactcaaaagggacaatatgtgtgaaaataccttggagagtgtagtaaagacaatagcaacaatcacagtacttttatactattgaagatgccagaagttgggatggtttctctctcactctgccttagggaaactgaggcacccagaattcaaataaagcagaaattgttgggggaggggacaataaaagcttactgggctcagagatgaatattgttacaatgatcatacaacctttgtggtagaatcaatgtggtatgaggaaatgaggatcctttgaaaggtnagaagatatacagaaaaagcaatcattgcccagtgctaaaaccaaaatgctagaatttggtttaaaccatttggttgaaaagtttgtttggccccattcctgcccttagaacatgatccaatgaaagcccagttgtggtggacaagatgtgcatggaaaggagctggctcacttaaaccttagagtggtatgtggagaaaacctggcatacaagatgaaggggagaaagaaggacttggccactgtatgaccctttacaggatccaaccaggccacctggaggcaccggagcagagagagattgtcgcatttggacacactaccttaata

SEQ ID NO: 306 - DNA, 661 bp, Homo sapiens
  misc_feature [331]..[331]: Chromosome 2, SNP identification no. = rs1032838
  misc_feature [331]..[331]: allele = a, in linkage disequilibrium with rs1504175, respectively
  misc_feature [331]..[331]: n is a, t, c or g
atggccacccagtagattttaactgctttgagagaaggggccgtgttttatttacctttgtgtctctaattccaagcatgtgtctggcacatttatcatataaatggtaaatgtaactggaaagccccccttattttcttcctaaaatgggtactaaatgtttcatgaataacttttttttgaaaatccatctttctcctagttttctcttccagaggggctccccaaggaagccttagaggttcttcaaactaatcttagtagtcacttgttatcctgtccaccaactcagctctaaagcattgttttcccccaatgccacattatcacnttatcttataattcatttctcctggctgctggtgggcacagtctcctcttcaaaagtacagctaaggccagattcatttatggattgctgatgaagtaatagaagcaccaccccaagtataatgtgcattgtcgcagcagtggctgcttctgcaacccacagacactaatctgtgagcctgagaatgttttatttcctcttcaatatgaacttccatttgtttcaagggaactctagaaaagtcagtggcaatagtcaacaatatattttcccaagtctacagtattcttatttaaataatgccatataaggagcattaattattaaact

SEQ ID NO: 307 - DNA, 661 bp, Homo sapiens
  misc_feature [331]..[331]: Chromosome 2, SNP identification no. = rs11125217
  misc_feature [331]..[331]: allele = a, in linkage disequilibrium with rs1504175, respectively
  misc_feature [331]..[331]: n is a, t, c or g
attttttactattttgaatgtgcctatggaaatttttaagtttcttttgtggcttgtattaaatttttattggacagtgctgctttagggtatggataatatattcttaggagtggaacttctgaatctgagggtaatgtaaatcagtcttacaagatgaggttaattttatttccaaatggttgtactaatttgaattctcattactagtgtataatcctcattgctccacattcctttcatacttggtattatctgattcttaaatttttgtcatattggtgattgcagattgaatttcatttgtcttattttgaagttctctgattancatttcaggtaaatttttttcccacatattccttagtcatttgtttttcttcttctggaaaatggttgttaatatattttgaccatttttatgtggggttttggccttttacttgttgagtttttgcaggtattttaaaatggaatatttgttctaatattcctcatagtttatggctcatattttcattttcttcctggaatattttgatgagcagaagttctttttttgtcatttttttaattatagtttaagttctgaggtacatgtgaagaatgtgtaggtttgttacataggtatacacatgccatgggggtttgctgcacccat

SEQ ID NO: 308 - DNA, 661 bp, Homo sapiens
  misc_feature [331]..[331]: Chromosome 2, SNP identification no. = rs11685850
  misc_feature [331]..[331]: allele = t, in linkage disequilibrium with rs1504175, respectively
  misc_feature [331]..[331]: n is a, t, c or g
tgtctcttttctttgttttttagcccccaaatggttattataatactcagtttcattgtgtttccttccctatctcatcagtaaggagtttgcagagggagtctctggagtcaagataaataggagactgggagttctataaggctaaacatacattatgtgaaagttgtggatgttagatatgaggtcctcaaaaacaaatctgttcatgcctgctttgtctagctcagcaaagagttgtggactattgttgaggggttggtctactctgatgtcctcttttctctggaaattgttctttctccactatattctgtgatcctagtaggantttctatcatagcacccagtctcactggccattgggatagacatgtgaccaagaccagcaatttccttatagtatccatagtgcctggcttaactgcctctgcatttatgaacggaaaactacgaactgaggtttggctctcctgtcttagaagacatcactgtctacagaaggagggaataaaatcagagaaggtaggtttaagagctggatgtacaagtaaatgatcatatcagcatcaacttcttaggctagttctcattggtcccagagcttcccttcttcccttagtgacacttttgtttctgtgagcccatccagtctaatggg

SEQ ID NO: 309 - DNA, 661 bp, Homo sapiens
  misc_feature [331]..[331]: Chromosome 2, SNP identification no. = rs9309160
  misc_feature [331]..[331]: allele = c, in linkage disequilibrium with rs1504175, respectively
  misc_feature [331]..[331]: n is a, t, c or g
gtggatgttagatatgaggtcctcaaaaacaaatctgttcatgcctgctttgtctagctcagcaaagagttgtggactattgttgaggggttggtctactctgatgtcctcttttctctggaaattgttctttctccactatattctgtgatcctagtaggattttctatcatagcacccagtctcactggccattgggatagacatgtgaccaagaccagcaatttccttatagtatccatagtgcctggcttaactgcctctgcatttatgaacggaaaactacgaactgaggtttggctctcctgtcttagaagacatcactgtctanagaaggagggaataaaatcagagaaggtaggtttaagagctggatgtacaagtaaatgatcatatcagcatcaacttcttaggctagttctcattggtcccagagcttcccttcttcccttagtgacacttttgtttctgtgagcccatccagtctaatgggacaataaggcccttttagtgtgagccactttctgttgagtttctgttacataatatacattcctgaaaaaatagaaatcactcattagaagtagggtgtcatcaggccctagaattcggaattgtttgactttgggtggtgtatgattgacaggattgccttcttgtg

SEQ ID NO: 310 - DNA, 661 bp, Homo sapiens
  misc_feature [331]..[331]: Chromosome 2, SNP identification no. = rs6720857
  misc_feature [331]..[331]: allele = a, in linkage disequilibrium with rs1504175, respectively
  misc_feature [331]..[331]: n is a, t, c or g
tatttttccccaaaatccataaccccagtctaatcatgagaaaccatcagacaaatccaaattgaggggcattctgcaaatacccaactagttcttttcaaaggtgtcaccagcatgaaaaataaaagctaagaaattgccacagattggagaagattaaagaaaatgcaatgtggaattctctattgactcctagaacagacaaaggattagtggaaactagaaaattttgtgaaatctgaataaagtctatagtttaacagtccagcatcagtattaatttcttagttttgataaatatttcttagttacataagatgttaatattggnggaagcagggtgaagggtcgatgtgaattctctgaactatttttgcaacttttctggaaatctaaatctatatcaaaataaaaagttttaaaaatattgtatcttacaaagttgtttaaggaaccacttcaataatatttgaaaatgcctagaaaagatctagtatcatacttacatataaaaaaatttttatttttctcatggggaaatggaaagagtggacagtagggatggctgctggaaggtgtaagagatgaaggaaaatattttaagtgacattcttaaaaggtccaaaatcattttctaactcctgctttttagaatgtcagc

SEQ ID NO: 311 - DNA, 661 bp, Homo sapiens
  misc_feature [331]..[331]: Chromosome 2, SNP identification no. = rs4564810
  misc_feature [331]..[331]: allele = t, in linkage disequilibrium with rs1504175, respectively
  misc_feature [331]..[331]: n is a, t, c or g
tgtatacatagcaagtacagcaatcatctaatgataatcttattattggaacagtgcctggcacatagcaagtgttccatacacattgttgaagaataaatgaatgaattaattaatgctggtctatatcggtcaccaggtgaggcagtgttggaatgtggtgatagcagtgaggagagattataaacccaccaaatcatgcttaggatgtgggagaataaccccaatcttagtctgtttggtaggggtgaggggtgaggttaagatcagagcaagatgagggttatcaaaagcagggagtgtgggtgagtgagatgttttgggagaaccnggattaaaaacacccagaagaaaaaagaaccattaaaatacaggacttgaggtgacccagcatctggagcagctttcaggacctttggcctttttcagaagtcagactgctccttaccaaggtctcagttcctctagatgagttgagtctcaagagtattctcccctccacagaagagcccactgactggaagtatggaaaaactgctacctgaatataaacaaaacaccctcgttacaattagacagtgatatgcccaagtacacaataccctttatcccagtacaatcaggaatatggatttccaccccagaatgggttccagttcct

SEQ ID NO: 312 - DNA, 661 bp, Homo sapiens
  misc_feature [331]..[331]: Chromosome 2, SNP identification no. = rs11125222
  misc_feature [331]..[331]: allele = t, in linkage disequilibrium with rs1504175, respectively
  misc_feature [331]..[331]: n is a, t, c or g
gatggtaaccatgggtgcaacaagaattggaagaaaggctcaaacaagagcttcagtagatcctgtttgctgccatagctgatctcatatctgtttagcattgcagtgtatccaaatgctggcctcagccttcctgacctttcttcatgttctattgcaatactcttacttgcttccttcaggttgttctctctcatccttgcacttcttcctcagttctggttacgtacctgtcttggctcaggctatcaccatcacttggaaatatattctcaagaatgtaagctcttatgatctatgaaactttttcaggttcccaagtcccaggacntttctatattcatcggactcctttaaagtactctttattttgcacagtttaataattagaatcataagatgtgagagttgaaggggtccttacagaccatatctagccatctcctttcatttgtcagatgagacaactgagctttggtgacagggtgttactcacgttagatcgtatgcttggaatatatgttaacatgtttgtttataaactgaaagttgctatagaaatagtagttagtactctttgagtggcagagcggcatctagaagccaagtcccctgactcctttctgcactatctgttatatcaagctgcctctactaaatt

SEQ ID NO: 313 - DNA, 661 bp, Homo sapiens
  misc_feature [331]..[331]: Chromosome 2, SNP identification no. = rs7582258
  misc_feature [331]..[331]: allele = c, in linkage disequilibrium with rs10497667, respectively
  misc_feature [331]..[331]: n is a, t, c or g
tattttgattattgttatggttttactgctgtgtacataagccaagcttatgaaattgtatgctttaaacatgcacaatgttttgcatatcaattttccttcaataaagctgttaaattaaaagcaaagaaaagcatttctgaatccttaacatagctcaaatgttaaagggaattcatctttattttttaaattactactacaattgattatatcaaagactacactactggcactaatagtggtctcataaaacagtcatattttactttgcacttttaaattacacaattttcaaagtatatacacacatatttttcaaaatccctanatacaaaccattaaagttgtaaaagaattttaaattattatatacaaacttcacaaatatatctgtatgcttataaatttatctttacagcaccagaatgcttactttttacagggttctaaattctattttactttcttaaagtctgatattctacaatttttctttgaatggcataccccttaagcataatgaaggatgatatgagtacctcttaacttcttgcagagtcttgtccaaacttcttatagaacacttctttttctcctacataaaaacaggtaaaataattacaaaataatgctaaggattggttttaagttttaaata

SEQ ID NO: 314 - DNA, 661 bp, Homo sapiens
  misc_feature [331]..[331]: Chromosome 2, SNP identification no. = rs12615770
  misc_feature [331]..[331]: allele = a, in linkage disequilibrium with rs10497667, respectively
  misc_feature [331]..[331]: n is a, t, c or g
ggaagatggaaaaacagaaataggtggttttcttgggaggagaatttgaggacaagttttataaaaattatatttcattttaaattctacattatttttataatgttgctttgtgtaattagtataataaaattaattatccagaagttaaaattcaagtgatctctataatatgctttcaacattgtttttgcacttcttattccactgttccattaaataaaatttctgctatctctatatcctctctattttcaaactatgaaaattacatccttgaattattttaaacttaaattccactattttataaatctcctgattatattcnctggaaataattcccttttccatataacaaccctaacttcttatgagaacgaatcacttaacccacatcatttaggcttttcattagcatttacgattttattttatttttcttttctcctcaaattgaaacaaaaaaatccttaaaaacaagactctctcctttgaagcagaggccacagtagcttgaaaacacacagtagtcatttaataaatatttattgtttcatcagataggtaatcatatgtttctaaagcaacaagatattttctcacggagtaacttttgactttcttttaaagttaaaagcataaacagagatgtgttgcc

SEQ ID NO: 315 - DNA, 661 bp, Homo sapiens
  misc_feature [331]..[331]: Chromosome 2, SNP identification no. = rs12998383
  misc_feature [331]..[331]: allele = g, in linkage disequilibrium with rs10497667, respectively
  misc_feature [331]..[331]: n is a, t, c or g
gtgcacattcccaagaagaaaacagtatatgcacaccaacaatacagaactcttatatttagaaacttttcaatttccaacacttctcttatttatggagtaccaaataacattggaattttccagatgttttaacacttttgtttcaaagtatcatctttcctgtgtagagtacaatgaggctgaccacaaaaaaaaatagaaaaaagaataagaattctatgtattgctatcgaaattttctgtcattacaatgtgtgccttagcttctagcaggtaggtatctatcaaaaatatatctctagttctatattaatatttataaattttncatggggaatatggacaaaaataaagagtatgttaaatctaaaaacattttaaaattagccacataaatagtttcagtacaagcccaaattttgtatatcttattggagaaagtaaaaaacaaatatggtttattccacacaggtaaagtaggaagacacaaatgaggaaataaatagcttctttcctgacagtgggaaaagcattaacaaagagctcaccaacctctaaacattattagtgctcagaaaaggcctagaagggattcataattaagcccttgggggaaacacaagaaataagtataaagttgaggcagtagaaaggaaag

SEQ ID NO: 316 - DNA, 661 bp, Homo sapiens
  misc_feature [331]..[331]: Chromosome 2, SNP identification no. = rs16827480
  misc_feature [331]..[331]: allele = a, in linkage disequilibrium with rs10497667, respectively
  misc_feature [331]..[331]: n is a, t, c or g
cccacaacctcaaaaaacactcctgcaacctcaaaaactaggactgatggtcaacttctgacaatcatttgagagaaatttacaccataatatgataaatcggacagagaattaatcattatttttgccagaaaatgagtaaaattgttagccaaaattaacattagaaatatattttattgagtactccagcttttcctggacagataaatgaaaaatctgtaaacattaaaactggccatctcttatttctttcaagcaacttgggaatgggttacctacttcctctataattacttttttctacgttttctgcatccattctgagacnaaatgctacccatggcaagtaagtacataggaggaggggaatggagttagcatagatcatcctgttaaagtttacatctcaaacataacatttttaactggaatgaccaagaagcgggagctacaaagctcagtgacctcaatgcattttgaagattatagtttttcatgtaccttttcttatgtgaatgtcgtaaaaccaacctaagaatgcattcatctgggttagttgtattaactaacattaacaactaataataaagttgtgttagttaatacaaccaacccagatgaatgcattcttaggttggactaagaacaatgcacattc

SEQ ID NO: 317 - DNA, 661 bp, Homo sapiens
  misc_feature [331]..[331]: Chromosome 2, SNP identification no. = rs12614513
  misc_feature [331]..[331]: allele = g, in linkage disequilibrium with rs10497667, respectively
  misc_feature [331]..[331]: n is a, t, c or g
atcctcatgcatttgcagaaatatctgaacttcatcataaatgtcagcacatctatagttgaaatttcatatttttatctgcaacttgataccctattttaactttatttttatgtaatgaataagatggtcaagttaagtatttaaatctttaagctataaagaattgttttcattttgcctttttttgtgcttttaacctggaataacatagatatttctttgaaactatattggtacttttaagttttcatttttcatttaatgtgagaaaactaacaactggcttttcagcatcatatgttaaattactagagatttgatagttatntatagattttaaagaatgatcccattcttcattataaataatttctcttaagagatctcactttagaagtctgaatgggtttctacaacttaaatttgtattactcttttaatgttttatccctaaaaaacacaaaagggtggttttatccctaagtttagcaaatgctattttggtaacagaccataaaatatagcttttaagtcctctaaaatcgatactcccattcaactgaagaagaaattgtttcttttttatttttttgagttgtttttttcctaacaacagtgcccttaactattcagcattcacatctgtgacttaaacaca

SEQ ID NO: 318 - DNA, 661 bp, Homo sapiens
  misc_feature [331]..[331]: Chromosome 2, SNP identification no. = rs10931222
  misc_feature [331]..[331]: allele = g, in linkage disequilibrium with rs10497667, respectively
  misc_feature [331]..[331]: n is a, t, c or g
ttttacttcgtaatacctcaaaactaattatgataacaggcaacacattttcagatactattatcattcttgtttcctcaccatgcttagttagtcctgaaagcatgcctgtctattttatgtgaagtgcttttcttccttttgctattcagcctccagttcggaactctggtattatctttctgcttggatgaatatccctgtgtagctgctttaaaaaaaagagagacagagagaaaccatactgatacctaatggagagactgcattcttgaacttcattattagagatataaccaccaaattgactttaaatgtgagatgcagatgnccacaaatgtaactttccaagttgtaatcaaaattttacatttaacttactattgcctctctataaaaaattcatttttgtggtttttatatatgctttatcctcacaataatttggttaaaatatataaaaatatataatattatacatatccaactatgtgaacatatatttggatataatatttggtatgtatatttagtaaaaaatatgaagatatattttgtaaatatatatatgtgtggagatatatatatatggggctatacctaataaatacattgtcctgcccattttaccaaaataaacacaacattttatacacacaca

SEQ ID NO: 319 - DNA, 661 bp, Homo sapiens
  misc_feature [331]..[331]: Chromosome 2, SNP identification no. = rs991084
  misc_feature [331]..[331]: allele = g, in linkage disequilibrium with rs10497667, respectively
  misc_feature [331]..[331]: n is a, t, c or g
gaataattggataattcctattcaagtctcatattttgtttcctcaatgataccttaataattaattaaattatgctgtcatagtactctgtatttattcttcttagcatatatctacatagattataattcaatacttgttgttgctcaaaggcacatcactctatggtggtacaattaaataaaaattctgaccaagaagcattactgagtactgagagtaacactatcaatacatagcaaaacttatcaaaagaaatctgcttattgcaactcctcccctaaagattcattcaacagtgtgatggctctaatccctttttcacttttntctgcctaaaacaatctgaattgtacctccacctaatcaactatcctcttcatttcttactcaattatctcgctacctctttactatatatagaaatctagtctttttcagcagcattaaaaaaatgtcttctaagaaggatagagaccttgtatccttctataaatgggaaagggttataaactcttcagtaatgtttaatttataaccttactacttacttagtccctatctttcttagatctcttacctataattgagggagtgaatgagtgaataaatatttgaaaaagaaattggtaatgacatcgtgattcactgacaatatgc

SEQ ID NO: 320 - DNA, 661 bp, Homo sapiens
  misc_feature [331]..[331]: Chromosome 2, SNP identification no. = rs13005466
  misc_feature [331]..[331]: allele = g, in linkage disequilibrium with rs10497667, respectively
  misc_feature [331]..[331]: n is a, t, c or g
ttatgtttatgctttaaggcacctacttctacactatataaacaaagtaataataggtaaaatataaaaatataaaactaaagtgctatgattggactcaaatataagacaaattactgtggtccagaaatacaactttcctgcctaatgggactgaatcagcacgtgtgctgcactgtggatccagagacaggcaacatctcaagtttggctctggtgaggtaatggacatcagtattgctccaaaagaaacattaactggaaacaggcacatggcctgatgtcaagaggtgggaagactcatgacagaaccagcatagtatttaaggangatgaatccaaactgtttccaatctgctgaatgtaactatgacagttataacaatataggcaaaaaggcagaaggacaaaactaaactgcatgatcagaacagctaagaacacaccttgctcccaagacccagactaggagatctggctctaaagagttggagcgaaaaaacccacaaaactcactaattcaaaaaaagaaaatacgaaaaattcaatgctaagaaaggcagcaattaaacattaacatcaaaataggagtgcagtccagaagatatttaacttcatagaacaatctatcaaagacttatattggatactgtcttagtct

SEQ ID NO: 321 - DNA, 661 bp, Homo sapiens
  misc_feature [331]..[331]: Chromosome 2, SNP identification no. = rs6750636
  misc_feature [331]..[331]: allele = a, in linkage disequilibrium with rs10497667, respectively
  misc_feature [331]..[331]: n is a, t, c or g
tcttattatgtaagaactatccctcataaggctatagttgccacagatagtgattttttctgatagatctggggaaagtaaattgaaagccttctaaaaatggttcaccattctagatgacattaagaaaatttctgattcatgggaggaggtcaaaatatcaacactaaaaggagtttggaagaagttgactccaaccctcacagatgacatagagtggtttaaaacttcggaggagaaagtataaaacttgacagatgagttgcttcttatggatgcataaagttgtttattgagatggaatctattcctggtgaagatgctttgaacnttattgaaataactacaaaagatttagaatattacataaacttagttgataaagcagtggcaggatttgagaggattgactccaattttgaaagttctactgtaggtaaaatgctgtcaaacagcattgcatgctacagagaaatattttgagaggaagagtcaatagatttagcaaccaccaccctaatccacaatatagtcaaaaataaacaaagacagaggaatatgtaaaaactagttggtaagagttaaacactagatataatcaggacttgaagaattacgattttcatactcccctaaatcttattgtactctgacctaatgt

SEQ ID NO: 322 - DNA, 661 bp, Homo sapiens
  misc_feature [331]..[331]: Chromosome 2, SNP identification no. = rs13003934
  misc_feature [331]..[331]: allele = a, in linkage disequilibrium with rs10497667, respectively
  misc_feature [331]..[331]: n is a, t, c or g
gccaaatggtctgaggctgcttgcatatcacctagacaaaaataaagatctttctaattctgccttgttcctctaggctgtatggcacagttaccatggctcccagggcaagaatgataggagggaaagagtggtaggaaattgaagccactgttagtgttctcagagtttgtctattcttctctctctctccagcagcagagaaagaagggaagcaggcattctgtacagcaggaaaggaatccttatgtacctaaaagagctccaaaacaggccaggcgcagtggctcatgcctgcaatcctagcactttgggaggctgaggcgagtgnatcataaggtcaggagttcaagaccagcctggccaagatggtgaaaccccatctctactaaaaatacaaaaaaattagctggtgtggtggcaggcacttgtaatcccagctacttgggaggctgaggcaggagaatcacttgaactcggagggcggaggttgcagtgagctgagatcctgccactgcactccagcctaggcaacagatcaagactccgtctccaaaaaaaaaaaaaaaaaaaaatcgccaaaacaacttactaagaaatttaaaatatgcaaactacatcaaaatggcaatggcatgtttacatttgcttgtttctttat

SEQ ID NO: 323 - DNA, 661 bp, Homo sapiens
  misc_feature [331]..[331]: Chromosome 2, SNP identification no. = rs12999989
  misc_feature [331]..[331]: allele = c, in linkage disequilibrium with rs10497667, respectively
  misc_feature [331]..[331]: n is a, t, c or g
agcttgattcttcacatgccagataagcaaagatttaagtattgtctgtttaaatatttcaactctctacaaagtaccttaatatctggagtagctcactctattcaacattgagcagcttgggcaggatttccctcagatttcaaccttgctgcctgctttccccactgaggaatatagccaatagggttgtaatattgcatccatattccaccaccgtaggtttctatatagagcccaatccctaatgtactttgctagggactctatatatctcagaacattccaaatacaaaaggaggatactgaaaaggaaacttcagaatatcanactctaaaatactacacttaatttacactaaatgaagtggtggaataatctccatttctgaccctaagcttgtcccatgattgtaaactcaactcgaccaaacattaaggataacttggtggtgttaaccaaggagataagagatgaaatgggtaatgcgattggggaggatccaaaacaaaaaaaagctttttcactcttatctatttcatctactaagcttttgagtattattttcaatatggtgttctacatttaaaaaaacagttgcaaaaccattctagtatatgaatgtcttcaaaaagcttgtgaaaatgcatattttgacaa

SEQ ID NO: 324 - DNA, 661 bp, Homo sapiens
  misc_feature [331]..[331]: Chromosome 2, SNP identification no. = rs13028175
  misc_feature [331]..[331]: allele = g, in linkage disequilibrium with rs10497667, respectively
  misc_feature [331]..[331]: n is a, t, c or g
ctgtttaaatatttcaactctctacaaagtaccttaatatctggagtagctcactctattcaacattgagcagcttgggcaggatttccctcagatttcaaccttgctgcctgctttccccactgaggaatatagccaatagggttgtaatattgcatccatattccaccaccgtaggtttctatatagagcccaatccctaatgtactttgctagggactctatatatctcagaacattccaaatacaaaaggaggatactgaaaaggaaacttcagaatatcatactctaaaatactacacttaatttacactaaatgaagtggtggantaatctccatttctgaccctaagcttgtcccatgattgtaaactcaactcgaccaaacattaaggataacttggtggtgttaaccaaggagataagagatgaaatgggtaatgcgattggggaggatccaaaacaaaaaaaagctttttcactcttatctatttcatctactaagcttttgagtattattttcaatatggtgttctacatttaaaaaaacagttgcaaaaccattctagtatatgaatgtcttcaaaaagcttgtgaaaatgcatattttgacaaaatacatgaattttaaattatttttgcaccaaaataaactcatac

SEQ ID NO: 325 - DNA, 661 bp, Homo sapiens
  misc_feature [331]..[331]: Chromosome 2, SNP identification no. = rs12999474
  misc_feature [331]..[331]: allele = a, in linkage disequilibrium with rs10497667, respectively
  misc_feature [331]..[331]: n is a, t, c or g
tatcatcccactctcttctgtcctgcagggtttctgctgagaaaatcaccgaaagctatattggggctttgttgaatgtgatatatttcttatctctggttttactttcagtattctttctctatttttggtttttgatactttgattataatgtttcttgttgaactcatcgttggattgaaattggtgacttttgagcttcctgtacttggctattgtcatttttttctaagacttagaaaactttaacttccagccattagtttctcaagtatgttttctaggccttttactctctcttatccttcagaaaacctgtttggtgaaaantagtttgcttgatggtgcctgataattcccataggccttttttattcttttcctttcttcttttttttctcttctgggtgaataattttaaatgtcctatttctatgctcaccgagtctttcttctgcttgaccaagtatgtagttaaagcttgctattgaaattttcagttcgggtattgcattctttatctctaggatttttattgttattgtttctatttatttgttaaacttctacttttgtttataaaatgttctccaaattttaattattttttaatctgtattttcttggagttccctgaacttctttaaggagattatttcg

SEQ ID NO: 326 - DNA, 661 bp, Homo sapiens
  misc_feature [331]..[331]: Chromosome 2, SNP identification no. = rs12373738
  misc_feature [331]..[331]: allele = t, in linkage disequilibrium with rs10497667, respectively
  misc_feature [331]..[331]: n is a, t, c or g
cttctctgatgttgttgcatcaattctttaacacttacaccacaaataccacacatttttaatttctttatttataagtctattactctttttactctaacaataatacagcttaatggcaaaacattgaaaagcacaaaagaagatttttaaatgatctgatacctcactatcaacattgtggtgttattacctatagtctctgtaaattttatttcagttcttgcatttacattgtgatataaaatgtgcttaaagaaaaaagtgcataaagcatatgccttgagttctactccaagatcttgaacaatcaacttcctctgctatagcnataaatcacaatcaggatttatcttcatcttcactaaatccctaactgttttccaaattagtgacaattttcaaccaaagttggtattgtaatttttgccaatcaattcgatgtgtaataaagattcatgtggttttaaagttcattacataactgtgtatgtagttagagggagcctaggccacataagactgttcctacttctgacatcaacataagtttggaggttcctcaaaccaccctcaggttcaacaattctttagaaggactcacagaactcactgaaagctgttctactagtatggcttattacagaggaaggatacagat

SEQ ID NO: 327 - DNA, 661 bp, Homo sapiens
  misc_feature [331]..[331]: Chromosome 2, SNP identification no. = rs10186498
  misc_feature [331]..[331]: allele = a, in linkage disequilibrium with rs10497667, respectively
  misc_feature [331]..[331]: n is a, t, c or g
tcccccagtctcctttttttttgtaacgtttttattattctctactcttatcagctttcaaaatgctgcataatttattacttactatatttctctttgttttttgtctcccattacaagctaagggagtttggtctgttttgttcaacgatatattccaagcacctagaagagtgtgtggcacacagtagtagatacagaataaataaataaatatctgtttttgagtgactgtttgaaaaacaatcttgactaacttaaaatgcacttgttgcccctccatcattccaaattaaaggtcaaactggaggtttcactggattacttttanataggtgcatagcattataatctgcgttcatccctttataatttgtcattaaataatacaacaaaaatgggtaatgcttaaaattcccttattcttattgttcagtatctaagcatcactatcgttttggcaataaagtcttatttgtcagatcatttaagatttgtattaattgcaatcaaaacaatcctttaaaataaacctccatatttatacatctatcgtatatacatgtaaatactacttttgcttaaagagatctgaaataagattcaactaatggcaaaaatagtaattcaaagatgattacatttggggtaaattttttat

SEQ ID NO: 328 - DNA, 661 bp, Homo sapiens
  misc_feature [331]..[331]: Chromosome 2, SNP identification no. = rs6725283
  misc_feature [331]..[331]: allele = g, in linkage disequilibrium with rs10497667, respectively
  misc_feature [331]..[331]: n is a, t, c or g
tgccaaacccataactaacatcatactaaatgtgcaaaagctggaagcattcccctggaaaattggcacaatataaagattctatctcacactctgatttaacatagtattggaagtcctgacccagcaatcaggcaagagaaaaaaataaagggcataaaaataggaagagaggaagtaaaactatccctgtttgcagatgacatgattctgtatctagaaaacaccatagtctctgaccaaaagctcctagatctgataaacaactttagcaacttttcaaaatacaaaattgcaaaatactttgcaaatattttcagaatgggagaanatatttgcaaaatcaatgtacaaaaattgctagcattcctatacaccaacaacagccaagctgagagtcaaattaggaatacaattccattcacaattgccacaagaagaatgaaattcctaggaatacaactaaccagggagatgaaagatctctacaatgaaaattacaaaattgctcaaataaatcagagatgacacaaacaaactgaaaagctttccatattcatggacagaaagagtcaatattgttaaaatgataatacttctcaaagcaatttatagattcagtggtattcctgtcaagctaccaatgacatacttcacagaa

SEQ ID NO: 329 - DNA, 661 bp, Homo sapiens
  misc_feature [331]..[331]: Chromosome 2, SNP identification no. = rs13419562
  misc_feature [331]..[331]: allele = t, in linkage disequilibrium with rs10497667, respectively
  misc_feature [331]..[331]: n is a, t, c or g
gttgctagacactctcaggaacctaactttatatttcctgtaagaatagtggttccgtatttgccagttctatatttgcagtgactttataccacatggtgactacgaataataaaaattggctcttcttttttccattccttacactatgaacagctatataccctggatgttgtgcataaaacaaacaagattcagagaggtgaggagaaaaaggtagatgggccagggacttcagggctcaaagagtaacatgacagcaatttttctggagtttgtcatttttttgcctcatatattctggattagttgcagaggaagccaagaaccnagaattgccaatagacacagaccaacacaaccccaagaaaatcctgttctaccaaccaaaggaccgggaaagaggcagcctagcaagagagaaaatgtttaaacaatagccactctattccagccaaatagcatgcgcgcatacgcgcgtgcacacacacacacacacacacacacacacacacacacacacaactatgaccccatccacccctacaccaggaaagaccaagtgaagaatctagaattgcacctttgtgaggctgtaaggagtcaccctaacaaccccaccaccacagtggtgtccgagaagggcaagtagggagctggg

SEQ ID NO: 330 - DNA, 661 bp, Homo sapiens
  misc_feature [331]..[331]: Chromosome 2, SNP identification no. = rs13394207
  misc_feature [331]..[331]: allele = g, in linkage disequilibrium with rs10497667, respectively
  misc_feature [331]..[331]: n is a, t, c or g
ttttttccattccttacactatgaacagctatataccctggatgttgtgcataaaacaaacaagattcagagaggtgaggagaaaaaggtagatgggccagggacttcagggctcaaagagtaacatgacagcaatttttctggagtttgtcatttttttgcctcatatattctggattagttgcagaggaagccaagaacccagaattgccaatagacacagaccaacacaaccccaagaaaatcctgttctaccaaccaaaggaccgggaaagaggcagcctagcaagagagaaaatgtttaaacaatagccactctattccagccaantagcatgcgcgcatacgcgcgtgcacacacacacacacacacacacacacacacacacacacacaactatgaccccatccacccctacaccaggaaagaccaagtgaagaatctagaattgcacctttgtgaggctgtaaggagtcaccctaacaaccccaccaccacagtggtgtccgagaagggcaagtagggagctgggagcagctctgaccccatggcatcagtggagagatccgaagaagatcatggacatccaccccacactatataatgaggttcccctctccctccacactgaggtagtgccaaagactacctagtggagag

SEQ ID NO: 331 - DNA, 661 bp, Homo sapiens
  misc_feature [331]..[331]: Chromosome 2, SNP identification no. = rs13421172
  misc_feature [331]..[331]: allele = g, in linkage disequilibrium with rs10497667, respectively
  misc_feature [331]..[331]: n is a, t, c or g
caatttgtaaaaaatgatagttaaaaatatgaggatttaaaaaaataattttgagattggtgcaaaccttcctttccaagtaagtcagaaatcgaagtcagttttttaaaaagatttaccaattagctacaataaaaataaaataatataaaaagttaaaagagaggcagtagcataaaatgaattgtttggaaatatgcaaaagatgaattaattctgtaatttataaatttaaaatataccaccactcacccattatgatggctactataaagaaaaacagaaaataacaagtattgatgaggatgtggaaaaaattaaaaccattttncactgttgttgggaatgtgaaatggtgtagccaactatggaaaacaaaaattaaaaatagaattaccaaaggatccaaaaatttaatttatataccccaaagaattgaaagcaggctcttgaagagagatttatgcacccatgtttatagcagcattattcaaaatagccaaaaggtgcaagaaacccaaatgtccatcaatggataaatggataaacaaagtgtggtatatacatacagtggaacattattcagtcttaaaaaaggaaattctgacatacactacaacaaggatgagacttgcatacattacgctaagtcacataagcc

SEQ ID NO: 332 - DNA, 661 bp, Homo sapiens
  misc_feature [331]..[331]: Chromosome 2, SNP identification no. = rs4284795
  misc_feature [331]..[331]: allele = a, in linkage disequilibrium with rs10497667, respectively
  misc_feature [331]..[331]: n is a, t, c or g
ggcaaaagttccttccttgttaagactgaagaatatttcattgtgtatatagaccatatctaaatgattattttgttctcattaggactggttctggaaacaaatctgatacagatttgttttcaataattcatgctatttttatctcccactcttcggtttttctgaatctctggaattaacccactccttcaatgttcttcggccccatagtatattgttttggccccatcctatgctccagacatttactccacctcctctggctgcttcccaggacagcctgttttctgagagctgataggagcttgtgaacatgccagtctatgtnttcctcatgatcatatgttaacaagctaatcctgaacatgctaataaaattatcttcattagaaggtacttcaaaacgattaatatgtggaatttaataaagtcaggactatttgatagagcaccttttgagaaaatataacaaagatgtcttttttaatactttattatatactctttttttagtaagttccaaattataatactcataaagttgagagttttaaacaacgtgggaagactatagaaggagacatttgcagttaaaactggcattttgatactcttctaatttttgcaaagttgttatagctggggccaatctaactgc

SEQ ID NO: 333 - DNA, 661 bp, Homo sapiens
  misc_feature [331]..[331]: Chromosome 2, SNP identification no. = rs2887816
  misc_feature [331]..[331]: allele = t, in linkage disequilibrium with rs10497667, respectively
  misc_feature [331]..[331]: n is a, t, c or g
ggactccaccctcaatctgcaactatatgaaaaaatggcagaaggaataacacattttgtcttcttttaaccaataacaaactccccacttagccctacaaccactacaccaggagatataaatttaataccatcaattaccaaaaaaaaaatactggttagggacttaacattttgtaattgacaaagctaattccaagctggcctacacaataaaggacatattttgatccacataaataaaactccagtaccaggtctagattcaagaaagttatactccagtggcgaaaaccatgtcaccataaatccagcttctttttgactttgnactctccccctcattggtgtctttaatcctcaagccacacattgcctttcatccaccatcagtacaagattgatattattcccctgtgatcaataatggctgctacagttccagccctcacatactaacacttcattatccttggaaatggggtctctttttcctctcatacaaagttctggaattcactaacctctcagtatctccaaatgtgtcatgtaccctgccctgatctaatcagtgtatgcagttgaatgtgacttaataatatggtaaaagcagtggagatctgtctttgagctaactcatataaatgaaaatcaaagaaat

SEQ ID NO: 334 - DNA, 661 bp, Homo sapiens
  misc_feature [331]..[331]: Chromosome 2, SNP identification no. = rs10497667
  misc_feature [331]..[331]: allele = c, g
  misc_feature [331]..[331]: n is a, t, c or g
catcaattaccaaaaaaaaaatactggttagggacttaacattttgtaattgacaaagctaattccaagctggcctacacaataaaggacatattttgatccacataaataaaactccagtaccaggtctagattcaagaaagttatactccagtggcgaaaaccatgtcaccataaatccagcttctttttgactttgaactctccccctcattggtgtctttaatcctcaagccacacattgcctttcatccaccatcagtacaagattgatattattcccctgtgatcaataatggctgctacagttccagccctcacatactaacanttcattatccttggaaatggggtctctttttcctctcatacaaagttctggaattcactaacctctcagtatctccaaatgtgtcatgtaccctgccctgatctaatcagtgtatgcagttgaatgtgacttaataatatggtaaaagcagtggagatctgtctttgagctaactcatataaatgaaaatcaaagaaatgttaattctgtaaagggaaattgaggcactactggcgagaaagaagggaataagaacagggtaaagaacgaacacatttctcctacaaagcagaaaatatgagaatttggaaagagttctaagtatataaa

SEQ ID NO: 335 - DNA, 661 bp, Homo sapiens
  misc_feature [331]..[331]: Chromosome 2, SNP identification no. = rs13388196
  misc_feature [331]..[331]: allele = c, in linkage disequilibrium with rs10497667, respectively
  misc_feature [331]..[331]: n is a, t, c or g
ggccagcagaaaagttgtaaatcaggacagtctcagacaaactgggaagcatgccatccttgaagctccagattcttctaactgctgccatctctacttcaatgtttcacagatacataaaattaaacgtgatacataaaattatcacgtttatgtatctgtattaaacagatacataaaatcaatatattctcttccaaacttagtccccttctagtcttccctttgtgagtgataccaccatccatccagaagcacaatgcaaacctggcagagttagccttgacacaacctccttcctgttattcttcatccagtccatcacatttanattgtaaaatactttaaatcatccaaactccccatctacactgcaatgtttcaaggccactttttcatcacctcgtaatgggactagagtaataaccatctaagcgagctctcaatatttatttttgcctttattccaatctaaataagtcatttcaaaacacaaatgtcatcaagtcaactacttgtttaaaacattcaatgatttcttattgatcttggaaaccaatgcaatgttcatattgagacacgatctggctgtgcctgcctttattacctgtctccctctactgcccctgctcctttttatccatctccagccacattagtt

SEQ ID NO: 336 - DNA, 661 bp, Homo sapiens
  misc_feature [331]..[331]: Chromosome 2, SNP identification no. = rs2370681
  misc_feature [331]..[331]: allele = g, in linkage disequilibrium with rs10497667, respectively
  misc_feature [331]..[331]: n is a, t, c or g
taagttttactctaaacccacccagtgtcggtttggtataccgtatagacgaacctcattcggacaataaatctctcgtaacttttgatcggtctttccaaatgaaaattgaatcaaccgacattctttaataactttaaaaaaagggcattcttttattatgctaactttattttcactttaagtctttagtttatgtcaatactccatatacgttatacgtttgagtttaatttttatcagatctctacaagttgaaatttggtaacaaaaccgtgtaagatatataaatttgaatttcaattatggagttccacccgataattaattntttgtcatatataaataagttcaaacacatatataatcttagatgtctttgatacatacaatattttacttctacttttgtaagattttatctttctttttatttttaccggtctataaatacttgtaaattgaagtctcatactatccttatttattctattatccgtacacaataacacaagtcaaaagtcttattttataacttcatacaatatctgtattactaccatctatatagggaagtcgtaggactttaagtgagatacttctttgaagtcgtatgactatagacttctgtttcagtcggctaaatatttagatactatgg

SEQ ID NO: 337 - DNA, 661 bp, Homo sapiens
  misc_feature [331]..[331]: Chromosome 2, SNP identification no. = rs12233005
  misc_feature [331]..[331]: allele = t, in linkage disequilibrium with rs10497667, respectively
  misc_feature [331]..[331]: n is a, t, c or g
tctagactatttttaatttgagtttgcatattgcatatacctcataactgtatttgatttctgaatttcacttttatttcaatcgtattattttcttacgggaaaaaaatttcaataatttcttacagccaactaagttaaaagtaaacctttctggctagttttcaatgctctctaaataacaggcttactccaagcagatatgccatatggtttggctgtgacccacccaaatctcattttgaattgaagtttctataatccccctatgtgtcgtgggagggacctagtgggaggtaattaaatcatggggacagttaactccatgctncggttctcttgatagtgagttctcacaagagcttatggttttataaggggctttcccctcttttgctcggcacttctccttcctggcatcatgtgaataaggatgtgcttgcttccccttttgccatgattgtaagtttcctgaggcctcctcagccatatgaaactgtgaatcaattaaacttctttcctttataaattactccatctcaggcagtactttatagcagcatgagaacagactaatacagtaaattggcactggtagagtggggtgctgatattaagatacccaaaaatgtgggagtgactttggatctgggtaacaggc

SEQ ID NO: 338 - DNA, 661 bp, Homo sapiens
  misc_feature [331]..[331]: Chromosome 2, SNP identification no. = rs8179713
  misc_feature [331]..[331]: allele = a, in linkage disequilibrium with rs10497667, respectively
  misc_feature [331]..[331]: n is a, t, c or g
tttcctttataaattactccatctcaggcagtactttatagcagcatgagaacagactaatacagtaaattggcactggtagagtggggtgctgatattaagatacccaaaaatgtgggagtgactttggatctgggtaacaggcagagtaggaacagtttcgagggctcagaagaaaaacagatgtgagaaagtttggagcatcctagaaacttgtttgttttgaccaaaatgctgatagtgatatggacaatgtctgtgtaccaaaatgaagtccagtacaatgaagcccaggctgaggtggtctcagatgaagatgaggagcttatcnggaactgaagcaaaggtgatccttgctaggctttagcaaagagactggctgatttttggtactacaatattttataatatcaaaagcaataaaatcaataacaaaaaaacagaaaaagttgtgaaacagggaaaatcttatttccaaattacaacataattagattcaaatgtctagttcttaaccgaaagccagaaggcatacaaagaaatagaggaaagtatggccaattcaaagggaaaaaaagaacaacagagactgtgtctgtagaagacctgttggcatatctattagaaaaagcctttaaaatagctattttaaaaatggtca

SEQ ID NO: 339 - DNA, 661 bp, Homo sapiens
  misc_feature [331]..[331]: Chromosome 2, SNP identification no. = rs13416578
  misc_feature [331]..[331]: allele = c, in linkage disequilibrium with rs10497667, respectively
  misc_feature [331]..[331]: n is a, t, c or g
ttattgcagaacaggaaatgtactccctgatccttcctctggaagcttcatctcagagggggatccggctgtatgaggtgtcagtcggcccccactgggaggtgtctcccagttaggcttctcgggggtcagggacccacttgaggaggcagtctgtccattctcagatctcaaagtccatgcttggagaaccactactctcctcaaagctgtcagaaaaggatgtttaagtctgcagaagcttctgctgccttttgttccgctatgccctgcccccagagatggagtctacagaggcgggcagtggtgggctccactcagttcgagtctncagaggtgggctgcggtgggctccacctagttcgagcttcccgccactttgtttacctagtcaagcctcagcaatggtggatgcccctcccccagactcactgccaccttgcaattcaatcttggactgctgtgctagcagtgagcaaggctccatgggcatgggaccctccaagtcatgcgtgggatataatctcctggtgtgctgtttgctaagaccattggaaaagcacagtattagggtgggagtgtcccaattttccaggtaccatctgtaacggcttcccttggctaggaaaaggaattccccaaccccttgcacttcctgggt

SEQ ID NO: 340 - DNA, 661 bp, Homo sapiens
  misc_feature [331]..[331]: Chromosome 2, SNP identification no. = rs12614595
  misc_feature [331]..[331]: allele = c, in linkage disequilibrium with rs10497667, respectively
  misc_feature [331]..[331]: n is a, t, c or g
aacaaacctaaatataagacctaaaactgtaaagcatttagaagaaaatacagaacaaagacttcatgacattggatttgacaatagcttcttagatatgacaccaaaggcacaggcaacaaaagaaaaaatagacaaacaggatttcatgaaaaaatattttaagctgtgcatcaaagataatattaatagagtaaaaaggcaacccacagaatgagagaaaaacatatgcaaatactgcatctgttaagggattaacatctagaatatacagaaaactcctaacactcaatgataaaaaacagcccaattcaaaaatacacttgaatanacatttctccaaagaaaatgtacaaatagacaataaacatatgaaagtgttcaaaatttctaatcattatggaaatgcaaatcaaaactacaattagataccacctcacagccattagaatggctactataaaaaaaaaaacccagaaagtaacaagggttggtaagaatgtggagaaattagaacacttgtacactactgctaacaatgtaaaatggtataacagctgtggaaaacagtatgatagttccttaaaaaattaaaaatagaattactatacaatctaacaattctacttctgagtctacacccaaaagaattaaaagcaga

SEQ ID NO: 341 - DNA, 661 bp, Homo sapiens
  misc_feature [331]..[331]: Chromosome 2, SNP identification no. = rs2370677
  misc_feature [331]..[331]: allele = t, in linkage disequilibrium with rs10497667, respectively
  misc_feature [331]..[331]: n is a, t, c or g
tgtcaagtcaccacaactcacatgtaagtactagacgttggtagtgatggtaagtagaggtattgggaaagacagaacattttgactttgaaatttgggtaatttgttattgagtggaagttaagaagagaaacggtaccgttggtggtaagacgaaagatagagatactaaaactgatgaaaatttatagagaatattcaccttaatatgtcataaacaaaaaacaatgatctaataaagtgaatcgtattacaggtgtaccaagtaggtataacatcgtatacggtcttaagggaaagaaaaattccggttcattatagggtgacatanatatctggtataaaacgaataggtaagtaggaagttacctgaaccaaacaaaggtgtaaaatcaataacacttattacgatgatacttgtaccattatctttatagtgaaactctgagacgaaaattaagaaaacccacatctgagtcttcatcttaacaatctaacatatcattaagataaaaattaaaaaattccttgatagtatgacaaaaggtgtcgacaatatggtaaaatgtaacaatcgtcatcacatgttcacaagattaaagaggtgtaagaatggttgggaacaatgaaagacccaaaaaaaaaaatatcatcggtaaga

SEQ ID NO: 342 - DNA, 661 bp, Homo sapiens
  misc_feature [331]..[331]: Chromosome 2, SNP identification no. = rs4500906
  misc_feature [331]..[331]: allele = a, in linkage disequilibrium with rs10497667, respectively
  misc_feature [331]..[331]: n is a, t, c or g
acataatatagcaaaaactatatatgtaaaaacatctttattttgaaaaggaactatctttccataattagccaattgatttaaaatattataagcaaaaatcggcctgatgcatgctatttaaaaaattattaaaaatagaatgtaaacccttaagccactgggtgatcaaatatctctcaagccaaatctcaaatgtttcacttggtaaaaaagtgttttcgtaagtcaaataattttattaaattttctcattacataagttacagaaatttattagttccttatcttttgactgttatatttagacaagaataaaagcaaaaaaaantatattgttattctaacacctttgttaaggcagcagtgtccatagcatatttgttttttatctggatgtttttatcaattaacaggtgattttaacaagttaatatatcgctctttctcaattttcatcagttacagggaattaaatggtcacaaagttttgtagtgttaggaccctataaagtgagaaggtgactccaactttggagaaagcagtatagaaaagaaatattcctaagagagaaaaacacatttttgtagctctattgaaatacaaactaaaacaccttcttgtttggctagttccagtatttttcttaccagttaaact

SEQ ID NO: 343 - DNA, 661 bp, Homo sapiens
  misc_feature [331]..[331]: Chromosome 2, SNP identification no. = rs16827554
  misc_feature [331]..[331]: allele = c, in linkage disequilibrium with rs10497667, respectively
  misc_feature [331]..[331]: n is a, t, c or g
tagtttgctattaaacaaattcagaaatgattaaaattaagatatgcttgtcaaaagagataaattacaggctcagtgacaaattttattaggcatttcttttactcattagggtgtaacatttctataaataagagttttatggatatggctaggaaatcagattctataatgtaaaatattttattcccctccacagaattcattaccacctataattcaaagaactatgaaataaagttatgaagaactgtgtatggtattattctttagcatgtataaataaatttatacataggtattttatatgcataaaactgaaaggatgggntccacactgcctaaatcacccatattgtttgaatttttataagaatgtattaattttaatatcagaataaatgataaagatactacaagaaaataaaaagcaattttggtcatttctgcatgatatttgctgacaatatacctcatagtcacaaattcctcaggacaagtgtacaaatgaatgcattttagtttttgttttttcacatgctaagataaaatatatagtaatccttaacatgactaattaatatgttgtttataaatatgttagaacaatctatattttgtaaatgaatctatgctctctatttcagaaaaatttaataac

SEQ ID NO: 344 - DNA, 661 bp, Homo sapiens
  misc_feature [331]..[331]: Chromosome 2, SNP identification no. = rs2370672
  misc_feature [331]..[331]: allele = t, in linkage disequilibrium with rs10497667, respectively
  misc_feature [331]..[331]: n is a, t, c or g
aacataaacaactaacaaaacttcccaataaataaaagaagaatatcttaaaactcaaacaaatgtataaaatttatattcaagaaacaaattatacactgaatgtctgtaaaagagagtcaaatgtatcgaagagaaaaataaaagaattgttacagaaaacacttccttttcaaaaattaaaactattacagaataagtacaacgatattgttttatgatatttaactcatcaaatatttgttttctttaacgactgaatgtcaagatcttcgacctttcaagttctatttctactcacttctaaaccacaaaccactgtcgaacgaangactgagtatctatcacggaagagtgacacaggagtgtatcacttttctcacttggtctaggaaacccgaatgtaatgttcccgtgattagggagggttttacagaacggaggatcatattagtggaatcccacatcttaagttgtacacttaaaaactcctctgtatttgtaagtctggtatcgtctactaaaacttaaatagtaaaaacagaatatacccagtatgaaagttacaaaatagattcttgagtaaatagattctttagtttgtagtaataaagaggtgacttaataacatggaaacatttttttttaattaacaggtaaa

SEQ ID NO: 345 - DNA, 661 bp, Homo sapiens
  misc_feature [331]..[331]: Chromosome 2, SNP identification no. = rs2370671
  misc_feature [331]..[331]: allele = g, in linkage disequilibrium with rs10497667, respectively
  misc_feature [331]..[331]: n is a, t, c or g
gacagaaatattcccaaagaacatacgtggtatatcaacccagaccagagataggtaaattggtgagacgaaaattaacttattaaatcagataaatgtacaatgaatcaagtacacgtaaaatgtacgacagttataacaacaattcatgattgaattttgacggtaaaacataaacaactaacaaaacttcccaataaataaaagaagaatatcttaaaactcaaacaaatgtataaaatttatattcaagaaacaaattatacactgaatgtctgtaaaagagagtcaaatgtatcgaagagaaaaataaaagaattgttacagaaancacttccttttcaaaaattaaaactattacagaataagtacaacgatattgttttatgatatttaactcatcaaatatttgttttctttaacgactgaatgtcaagatcttcgacctttcaagttctatttctactcacttctaaaccacaaaccactgtcgaacgaacgactgagtatctatcacggaagagtgacacaggagtgtatcacttttctcacttggtctaggaaacccgaatgtaatgttcccgtgattagggagggttttacagaacggaggatcatattagtggaatcccacatcttaagttgtacacttaaaaactcc

SEQ ID NO: 346 - DNA, 661 bp, Homo sapiens
  misc_feature [331]..[331]: Chromosome 2, SNP identification no. = rs7584724
  misc_feature [331]..[331]: allele = c, in linkage disequilibrium with rs10497667, respectively
  misc_feature [331]..[331]: n is a, t, c or g
ttagtatggctacatctctctataatctctatctccagtcttaactcacatcattctcactcctctctatagttcattctttgaaactgttgcacctttgcacatgctgttgctgttactaaaatgcatttactccttctttccttcaatccttttacaaattatttcccatttattatttcaatctcaaatgaaacagaacatcttttgagaaggtttcagtattctatttaaattacgttatgatgttataatctctcataattataatactttactatgatttttcctatttgaaaataatggatttatttattgctattctacgtantcattttcatctcaatgctataatcttccatagataaacaatcatacctgctttgtttaccattgtactcctggaacccacctagtgtctggtatataaaaaaggctcaataaatatttatttgagtgattaaaaacattcttccattatagatataaaaagtggaacttagagataacaaaacttgcttctaagtcacactgctaaaaagaggaagaacaaggattagaatctaagtatatagtactctaatctgttcacttattcaactgagccactcccttcttacaactgtcccagctactcatttacacagaggaacttaaaata

SEQ ID NO: 347 - DNA, 661 bp, Homo sapiens
  misc_feature [331]..[331]: Chromosome 2, SNP identification no. = rs4461230
  misc_feature [331]..[331]: allele = t, in linkage disequilibrium with rs10497667, respectively
  misc_feature [331]..[331]: n is a, t, c or g
tctttcccttcctcacaattctgttacccttcattgtgaggcagagtattcccttgggatattttctaccttaaaataaatactacaagaaaacggtgaaataatagtggcttctatcagtcatgggctgccagctcttgcgccttagcttctctcacttattaaggagctgaaacccaaagaatcagttccaggcctcaatctgattcttaaaatactatatacagcatattgacaacactcagcctgccatggttattatatccctttcctgtcaccaagactgggatggaggggggtggttaactctatgacattgaatattgttacntcagacacaaggttttttcattttcaaaaatcttgaacatatctggtgttctaatgtctcctttaatagcttactgtattcatctattttcacactgctataaccatagacctgacacttggtaatttataaagaaaagactttaattgacttgcagttctgaatgtctagggaggtctcaggaaacttacagtaatggcaaaaggagaagaggcacgtcatcttccacgcaagagcaggaaaaattaccttataaaaccattagatctcatgagaactcactcactatcacgagaacagcatggggaaaaacggccccatgatccaatc

SEQ ID NO: 348 - DNA, 661 bp, Homo sapiens
  misc_feature [331]..[331]: Chromosome 2, SNP identification no. = rs16827602
  misc_feature [331]..[331]: allele = c, in linkage disequilibrium with rs10497667, respectively
  misc_feature [331]..[331]: n is a, t, c or g
gacactaagtgaaaccatatcagttacctaccatccacttttcccttcctttctaggatgttttatttgttcatcaaacatttacagaccccctactctgtcccagactcagaaccacacatctcttatagtgaaaaatgtagaaactgccctccccttttatgaacatcaacataagacaattacaagtttgatttgtggttttccacttaccagtcaaaacttacacgcatgcttcttcctgcatatgcctcttcaaaatatttcaataactatatttttaatttgttaaggaataataacttttacaagtatatgctactaatagttnacaatacctcctggaatgccataaaatgaatttaaaaactaattctcctcaccgtcagtgcaattagagagtctattccaaaatttcttccctctctgggtaaaacataatgaagcttaggaggcatgaggtgcattatagttaaattttagtatttttttattgtcttcattaattccagtaattttgtagaaggtaatgtaaaaaggcaatctagtagttttaggtcccccacaaaaaaaaaaaaagaaataattttgtggactagtcatataccaatgtggttctcacccttataagataatttaaatcatttggggaacaaacaaa

SEQ ID NO: 349 - DNA, 661 bp, Homo sapiens
  misc_feature [331]..[331]: Chromosome 2, SNP identification no. = rs6434164
  misc_feature [331]..[331]: allele = c, in linkage disequilibrium with rs10497667, respectively
  misc_feature [331]..[331]: n is a, t, c or g
aaggtctttgaccaattttttaaatcacatatttttcttattgttgaattttaaaagttctttttatattttaaataactgtcttttaccagatatatcttttgcaaatattttctcccagtctgttgcttgtcttttcattctcttgacaatgtatttcccagcacagatttttttattttaatgatatccaaattattttttctttcattgattatgcttttgctattgtaactaggagggtatagtcaaacccaaagtcatctagatttccccaatattatatactaagtttttttttgttttagttttgttttacatttaggtctgngatccatttttgagtaagttttgtcaggagtgtaaagtctctatctagattcgttttgggcagggagtgaatgtccgattattccaacacaatttatcgaaaaaactgtctttgctcccttgtaaggcctttgctcctttgtcaaagatcagttggttatattgatctgggcctgtttctgggctctctgttctgttccactgttctatttttgcattctttcaccaatatcacgcggccttgattactgtacctttatcataaaagtcctatgctgtcagtcctccaacttttttcttctcctacataattgtgttcattattctgtgg

SEQ ID NO: 350 - DNA, 661 bp, Homo sapiens
  misc_feature [331]..[331]: Chromosome 2, SNP identification no. = rs2370670
  misc_feature [331]..[331]: allele = t, in linkage disequilibrium with rs10497667, respectively
  misc_feature [331]..[331]: n is a, t, c or g
cgagaacatatacgaaacgaaaaattaaaaggaagagatcagagagatcacggaaagagatttgaagacttttaagtatccatagaaacatgtttaaaaattctacagttaaggtacccgtacgttctacgtcctttaatcactcgtttggttggttttcgaataaaggtcagggatgaacggtccccgggacccgtcctatgtgggacgtagtggactactctaccgaaatcggagagagatctacgctcaaagaaagagaggaaattatagaaccatatagaaagaaaagagtaaagataagaaaaataaagagtaaatagagaattanagaagaatagaactgaagacaatacttattatactttgtccatctgtcaaaagctaaaaataaatgaatgatttttatttactttcaagttaagaaaacaatttgtgtgttttaggtgtattcatttatacgaaaacatgtacaaggaccttttttttttcaaagaatgttactaaaaaagatatctttttcatgaaagggagaaacatggatgactgtgatgatcttaccgatcaaaagacggactgtcgtttacacgacagtaaacaatattcggtatcttttggacgttcgttaccacaactcagtcacctttccgaaaggaagtct

SEQ ID NO: 351 - DNA, 661 bp, Homo sapiens
  misc_feature [331]..[331]: Chromosome 2, SNP identification no. = rs16827614
  misc_feature [331]..[331]: allele = c, in linkage disequilibrium with rs10497667, respectively
  misc_feature [331]..[331]: n is a, t, c or g
ttgagatcatctccaactggtattcttatttgcctctttccacattctttccattagtcattctcaatctgtctttcttctgggaaatataatggaagatattcacaagtgcacaaccaggttttaatgaaaccaagaaaaaatggttgcaggcaaagtattaaactaatttatttgtagctataactattaatagtatctcaatagaggtcactttcaataggataagccatgaaaagataagccatggcttttgtacaattccaggccaaggaaactgctcttctctattaaagcaaattaggaaacaaatgagtagcattattaatanagcacacctctgtattagtccattctcacactgctaataaagacatacccaagactggataattcataaaagaaagaggtttaattgactcacagttcagcatggctagggaggcctcaggaaacttgcaatcatggtggaaagggaagcaaacatgtccttcacctggaagcaggaaggagaagaatgagcagaagggggaaaaggcccttataaaatcatcagatctcgtgagaactcacgatcaagagaacagaatgagggtaaccaccccgtgattaaattacctcccatcaggtccgtcccatgacacatgaggattatgggaac

SEQ ID NO: 352 - DNA, 661 bp, Homo sapiens
  misc_feature [331]..[331]: Chromosome 2, SNP identification no. = rs3107174
  misc_feature [331]..[331]: allele = t, in linkage disequilibrium with rs10497667, respectively
  misc_feature [331]..[331]: n is a, t, c or g
aaattcaatttaagtagttttaagaaaatgcttgatttgagccacttaggattcttcttctacctctaaactatctttaaattaaggaaataaatgtagtaatgactttctctgttacctgttttccataaaacacacacatgcacacaaagtgggaatgtacctcaaccaggtgcttcaggaattttaggaatattagagacaaatgggtttagagtaagagatgtgataatgtgatacatcagcctaagattcagcacaggcaaaaaagggaactgcctgaaaaattatggtagatttctccaatacaacacataggaagttccagaancagagaaacagaggcttggaaaaatagcgcataattgagcaatgtggatgtaaattaaaaacaaattacttagaacctccctaatgtctgggataagaaacaacttgattcggcatttcttcccaggtcctgagttaagtaatcagccctcagcccagagtcacacaggcagtagtttgaacctgggtctctgaacaggttctcatccactattataaactgatatcaatacagaacatgaagaagtagagagccaaaggacactaatactttggctccatcctcccaaaatcccattggaatgacagaagaaatatttaaaaattaaga

SEQ ID NO: 353 - DNA, 661 bp, Homo sapiens
  misc_feature [331]..[331]: Chromosome 2, SNP identification no. = rs3107423
  misc_feature [331]..[331]: allele = g, in linkage disequilibrium with rs10497667, respectively
  misc_feature [331]..[331]: n is a, t, c or g
tagtcagctacacagacagaaacattgtcatgatacgacaaaaacaatgatatcgaaacatcatattagacttcagtcattacactaaggaggtcaaaacaagataaatgagtcctactgaaactgataagaccgacccagaaaacaccaaggtatatttaatatactaataaaaaagataaagacacttcttacagtaaccataaaacgatctctaacgtaacttagataacgacagaaaccaatcatacctgtaaaagtgttactactaagaaggttaggtattcatactttataaaaaattaaacacacacgggacattaataaaacngagtagcaaaatatcaaaaacaacatctctagaaagtgaagaaacaaattcgaataaggatacatagaacaaagtaaaaatcgataacatttaccctaataaagaactaaaagaaaagtctaacaagtgacttccgtaaatccttacgacgactaaaaatatacaactaaaacataggatgttgaagtaaattaagtaaatagtcgagattatcaggaaatcaccttagaaatccaaaaaggttcttattctagtaatgtagacgtatgttcctattcaactgaagaaggaaaggataaatgtacgggaaataaagaaagagaacagact

SEQ ID NO: 354 - DNA, 661 bp, Homo sapiens
  misc_feature [331]..[331]: Chromosome 2, SNP identification no. = rs2887818
  misc_feature [331]..[331]: allele = a, in linkage disequilibrium with rs10497667, respectively
  misc_feature [331]..[331]: n is a, t, c or g
gtggaggtcgtactttctaatctaaagttgtactctaaaccaacttctgtgtctaggtttggtatagtcagctacacagacagaaacattgtcatgatacgacaaaaacaatgatatcgaaacatcatattagacttcagtcattacactaaggaggtcaaaacaagataaatgagtcctactgaaactgataagaccgacccagaaaacaccaaggtatatttaatatactaataaaaaagataaagacacttcttacagtaaccataaaacgatctctaacgtaacttagataacgacagaaaccaatcatacctgtaaaagtgttacnactaagaaggttaggtattcatactttataaaaaattaaacacacacgggacattaataaaaccgagtagcaaaatatcaaaaacaacatctctagaaagtgaagaaacaaattcgaataaggatacatagaacaaagtaaaaatcgataacatttaccctaataaagaactaaaagaaaagtctaacaagtgacttccgtaaatccttacgacgactaaaaatatacaactaaaacataggatgttgaagtaaattaagtaaatagtcgagattatcaggaaatcaccttagaaatccaaaaaggttcttattctagtaatgtagacgt

SEQ ID NO: 355 - DNA, 661 bp, Homo sapiens
  misc_feature [331]..[331]: Chromosome 2, SNP identification no. = rs3112312
  misc_feature [331]..[331]: allele = a, in linkage disequilibrium with rs10497667, respectively
  misc_feature [331]..[331]: n is a, t, c or g
gctgggattacagacatgagccacagcaccgagcctctaagctcgtttttaagtcttatagaaaactagtattacagaataccatgttaggctgctggtgtctgtgacgtgtttgagttgtcagagccagttgaggttgttttcctaaaacttttagctattctgttaaagcataaatggttgagacttctaaagctcctgagacttggtctccttatcttcaacatggaaaagcacttctattgaagtattgtacaaaatcaaatagccactaagtgacaaaactgtgctgcaaactcaatctgttggactactaagccttccaccacancaccttgccctacatattctcaactttttgttgaaataactgaaatcttaaataaaataatatatatgaaagcactttctagaacatagcacattgtgggtaataggcatcagtatgtattaatgtccttaatttgtgaggattattgttctcctacataatttcaatgacaaagaaaaaaggatctaaataatagaagatatctaagtcaaacccatcacaaacattctgagttcttctctcctccttgcaatttaaataatacacatctattattagtagagaggtaggagtggcagtaaggtataaggacacaaaatgttctttgga

SEQ ID NO: 356 - DNA, 661 bp, Homo sapiens
  misc_feature [331]..[331]: Chromosome 2, SNP identification no. = rs1878754
  misc_feature [331]..[331]: allele = c, in linkage disequilibrium with rs10497667, respectively
  misc_feature [331]..[331]: n is a, t, c or g
gattataaggaaacccaaatccgggtcattaccctaacgacctagtttactataaagacagaaatacagaagccccttagtggtgtgacagaaggtgttatcaactggattaaatgtgagggtggttctcacatattccgtaagaaaaagagttgttggagtggtcgtacaatagaaaactgaaaaattattatcgacaagactgatcacactaaacgtaaagaagtactagtcattacatctcgaaaaaagtatacaaagaaccggtgtgcatacagtagaaaccttttctaccaggaaaccacacgttgaaaagttcagaaccttagtntaacctgcggtgataggagtattggacaagatataactaaaagtgtaccatgaacgtaaaaaatatgttatcataagtgatttttacgtcaaaaggattctatgaagtaaagttggaccatttttgtttacaattttgacttaaaagagttcgatcatcaagtgcgtcacagaataatttacaacttataatggtacaaaaggagtttttaaattttataggacagtggtggggaggaaggggcacttaagcgatcccatggtaatccattgaactgtgtctcaaacctacgatactgatattcctttttgacgacccactttacagtcc

SEQ ID NO: 357 - DNA, 661 bp, Homo sapiens
  misc_feature [331]..[331]: Chromosome 2, SNP identification no. = rs3112315
  misc_feature [331]..[331]: allele = a, in linkage disequilibrium with rs10497667, respectively
  misc_feature [331]..[331]: n is a, t, c or g
atattgtttgattaatataatgtggagttattaatactaataatccacacctttaaatatccagctttcagattaaaccaacgtcactgtggtgaaagacctgaaataagtattatgtgcctctctgacatctaagcctgggaaggactagctactcaggaggctgaggcaggagaatcatttaagctcaggagtttgaggttacagttatgatcatgccactgcactccagcctgggtgacagagcaagactctgtctctaaaaaaaataaaaataaaaataatgaaataattaaaaaataatgtctttatatgttacttggtacaatgnaatttttggacgcaaatttaaaagtcagtcactaaaattgcatggcaggacttacaggtgagatccagctagtgcagaaactgcatttattaaaatttttcattataaacattttgaaaactatgctgggggatgtacggacacctggcttagctcttcctagtaatactaggaatcaaaaattattatctcaacttcagtatgtactaataaaataaagtataaaaactactaatcaaaacaaatttaaaaattaatattaaaaactgaacttgaaaacaaattccatttcaatttgatataaattatactaaagcttaattatatata

SEQ ID NO: 358 - DNA, 661 bp, Homo sapiens
  misc_feature [331]..[331]: Chromosome 2, SNP identification no. = rs2370659
  misc_feature [331]..[331]: allele = c, in linkage disequilibrium with rs10497667, respectively
  misc_feature [331]..[331]: n is a, t, c or g
catctaaaacagcttatttatcaagattaacagctagttcatcaagactattctgataacagtttgctcattaagatatgcatctaatccctcaccctattgtgcctgccaatttaaagctattagattggtatattataaactttcccagtctgactcagttccccaagttgtaaagcctaccttttcaaatcacccgattcaggcccaaagattctatgttttctttcctaaatgactccctttttatatgctgctaagaccctgtcaatgtagtgttgtctgtgttgcaataagtacaataaactttttcaacagttttttttctggngatctttatgggggctttttgcataattttacaagaaaggaaattgagacccaaagaggttacacataataaaaagcagagtaagataacctgtaaagttaagctcttaaataattctactgtccctctgaaattaatgggaacaacattaaagcatctaaaggcatgattccatgcataaactccagtaactatgtactttgttattggggtgatcatataattaaccatctcagctgggacattttaagagtgaagagaattggtaattctattgagacatagcatgtaccagatctgaagctagcaaactaaaatatatggtcatca

SEQ ID NO: 359 - DNA, 661 bp, Homo sapiens
  misc_feature [331]..[331]: Chromosome 2, SNP identification no. = rs3112316
  misc_feature [331]..[331]: allele = a, in linkage disequilibrium with rs10497667, respectively
  misc_feature [331]..[331]: n is a, t, c or g
gttacacataataaaaagcagagtaagataacctgtaaagttaagctcttaaataattctactgtccctctgaaattaatgggaacaacattaaagcatctaaaggcatgattccatgcataaactccagtaactatgtactttgttattggggtgatcatataattaaccatctcagctgggacattttaagagtgaagagaattggtaattctattgagacatagcatgtaccagatctgaagctagcaaactaaaatatatggtcatcatctctctctcacacatttttaagcccaaagagaatgatttctaaaaatctctagccatnagacaaataaggcagaagtgcagaaaagaaataaaaaatatttataaagcatggaaaatattttgatacatcacaaatagttacttttcaatttgtccaagggccaaaatattttttgtaaaaatacatgcacaccctttgttacaatttgcgagttgaactaagtattatatataaaataacatccaaaatatttaaattacttttaatgagtcattcattgttcacttggtaatgaacatgactaaaaggtgatttcttttggaattgcctcattctcctaggcaaaacattagagattttttcatagttcttcgtttctactaagtt

SEQ ID NO: 360 - DNA, 661 bp, Homo sapiens
  misc_feature [331]..[331]: Chromosome 2, SNP identification no. = rs3107410
  misc_feature [331]..[331]: allele = g, in linkage disequilibrium with rs10497667, respectively
  misc_feature [331]..[331]: n is a, t, c or g
gttaatgttcgtacctactaaaatttatataaaatgaatggtttataactatttttaaacttaaaagttttggacaatagttataagtcagtcttccaataagaattttagtatgaatcgaaattcaattaacgacaccattcagtgtcttggttaaattagtttgatctcagatgaattccacaatactaccggtattttgtaatcattaagaccgtgaatgtctttcacaggaagttacaaagtccctgataatgtcaaagaactacaaattgacagtgtacttctctctgaaacatcctggtctttacctttaatctggtggtaaacnatttgttatgttttctccaataagtcttaaaacaggtgacaccatcatgatgtccgtactcgtaatgacagatacatttatgccagtgtaaggagagttttcatcgaataaaatgagaaatgacttttgagatattaaaattccggaccggtttataagatgtagaagaccttaaaaataaactaagatagtcaagataagagatggtgtaagtctaccaacacctttatattagatatgacaaaagtgtaaattaataaaaagtattagtataccgataaaagaatacaagtatcagatatcctcaaagttactttcaagaacttaaat

SEQ ID NO: 361 - DNA, 661 bp, Homo sapiens
  misc_feature [331]..[331]: Chromosome 2, SNP identification no. = rs3112317
  misc_feature [331]..[331]: allele = g, in linkage disequilibrium with rs10497667, respectively
  misc_feature [331]..[331]: n is a, t, c or g
atgatgtatactctaaagagaatttctactaatagaaattggtttgcatttaatcaatcaaaagttataagttatctgacttaaccagaattacctaataccattccttcctgagccctgcctcttaacatctgtctctttctagaaatcacctttggctgttcctacttttcaaaccttatcaagttttcaagacccagttcaagacccatatcacccatgaagttatccctggtctcctcagtctaagtaagctttctttctcccctgaaagcatacagatccaattatataattcacctagctttatcttcttttttcttgaattatnagttatattttcatagatctctagacacataaatatatagagatatggtttgcttccccaattagaccaaacactctgtaaggaatcagacttcttatccaagattatctactctatggacagaatgaagcaataagaggaattatatactctataaactttcaagatagaaataaacacagttttgcattgatgttcatcaggaatattggtctaaaattctcttttttttgttgtgtctctgccaggctttggtatcaagatgatgctgacctcataaaatgaatgagggaggattccctctttttctattgattggaatagtttcag

SEQ ID NO: 362 - DNA, 661 bp, Homo sapiens
  misc_feature [331]..[331]: Chromosome 2, SNP identification no. = rs10195099
  misc_feature [331]..[331]: allele = g, in linkage disequilibrium with rs10497667, respectively
  misc_feature [331]..[331]: n is a, t, c or g
caaaggtgaccaataaatatttgtttaacaatctacttattcaaaatggcactcatcttttaatgtataaatttcctaagaaataaggtattctgacttggttttttcctgccatacatgtatgttatacatcactacagcaagtggctcaagtggactgcctaatagtcttatcatctgaaaatctctgattgtcactaaaaaaactactgcattggagtaataagtaattcatcacctctaatctcaattaagtaatctaaatagactctcaagttgttgttggaatcaataagccataaaaataataacatggatatttaccttaagntgtttctattttgttttacagtaaaaattctttgtagaaatacatgttagaattcattgtttaaagttcatctttaaactgatcaagtatctacttgttacattaggtcccaagtaatatactgtaagcatatataggtcaatacactttgtaaatttctgcagccaaaatattcactctaatccaagcctttcaaatggattctattgctcacaaatctagaaaagacaagaaatcaaatttcttttcttcttaaatgacatcacaactcaaagacctctacgttctaataattcttcactaacaattttcttctttttctaagaataa

SEQ ID NO: 363 - DNA, 661 bp, Homo sapiens
  misc_feature [331]..[331]: Chromosome 2, SNP identification no. = rs2370662
  misc_feature [331]..[331]: allele = a, in linkage disequilibrium with rs10497667, respectively
  misc_feature [331]..[331]: n is a, t, c or g
ttctaagaataagaaattatataccaaagaaagattcaaagttccctgcttcttctaaatattcaagacaaataaaaatatgcaagatgaatggaaaaaataaaatcaataccaagatttaatagtatcaattcattcagtccgtattggtaggtaaggaaggactgtgaaaacctctttccacttgctcttaactctcagcagaaaatggaaacaaattttacaatagagacgtaaccacaaccaaatgtattttatatatttcagagaagcaatatggaatagttgggttaaatgtgtctctgatgtcagactttccgggtttgaatgncagctctgcctctctttagcacagtaatgctggataatttactaaccctatctgtgtttcaatttcctcatatgtaagataggaataataacagaacctgcctcatagatatgttaggaggaggtactccatgtaaatcacttggcatagtacctggtacatattaagcaacacttgataagcattagctaaatgtaaattgcaattgccttttaagttttaatatccctatttaaaaaaaaatagttgattgcttttactaactaagccagaaaagggagtactttttaaaaatttaaaaacctatcattttctctcaatgaatcaata

SEQ ID NO: 364 - DNA, 661 bp, Homo sapiens
  misc_feature [331]..[331]: Chromosome 2, SNP identification no. = rs10931232
  misc_feature [331]..[331]: allele = g, in linkage disequilibrium with rs10497667, respectively
  misc_feature [331]..[331]: n is a, t, c or g
aatcgcctgattattttatttttaaattttgttcataattttgcagtcattgtatgcctgcaaaattttttaaatccaatctcagattttcttcttgttagttaagcccagatctaagcaaaggtggctgatagaagaaactggagcagaccaatgggaacttcctatagagagtgttaccttttgttttcccatggattagtcacctctagcatataaatttaattttcccctaccgaccctgtaacactctttaattacaccaacccttctggctaaactgttgaaaataaatgtatagtaaagagttatagagtggtatgttactggnttatcaatgctcacgatttttttcttagtaaccagcacagtgtaaaggtggttccacaaggagatgatagctgtaggaaagactatcttaccatgaggaaagccaaaaagtgggcaactcaataacacaattaaaaacaaaaattaaaaactcaatgatctggtacatgtcagtaggatataactattcaaataggaaaaaattgaccatcggtttacatttagaaacacatgtcagtttacgttctctaaatataaagtcaaaaacgaagtcattactcttgttgcaccatatataagatgaagtattgctgtgcttttaccacctcaa

SEQ ID NO: 365 - DNA, 661 bp, Homo sapiens
  misc_feature [331]..[331]: Chromosome 2, SNP identification no. = rs2029085
  misc_feature [331]..[331]: allele = a, in linkage disequilibrium with rs10497667, respectively
  misc_feature [331]..[331]: n is a, t, c or g
tatcttaaaactaatacatcgacgttaatacaaaacctagatgtgcctggagaaatacggttcatacaaacgatactatctatccattactaaatagtttgttaaattgtgtaccatagattttaccttatactctttttttcgttttaaattttacttacgaaattcttctgagatatttccacgtaaagtttctataaaacaggttaatctacatccaaaagagagattaaacttcttagttattttcttttacgtaataccctcccaaatacctttttttcgttgtatgttgaaacacgagtaatcttgttattattttttcacctgnatgttgttttgtaactttttataaaatatagaaacatacaaatctcaatttttgttttacaaattctatccgtacgtagttataaataaatggaaaaattgactgtaaaacgattgaatagtcgatattcataactattacaacctattcttccataatctacgaccgtccacgttgacctatattatgtcatcaaagttactctacaacttcattcggtcgtacagtgaggttttacggaggaactctatattcaataaaaactcgatttccgttattctttgacgtttaactctccttcgatagagatgggagaagagaaagacggat

SEQ ID NO: 366 - DNA, 661 bp, Homo sapiens
  misc_feature [331]..[331]: Chromosome 2, SNP identification no. = rs10497669
  misc_feature [331]..[331]: allele = a, in linkage disequilibrium with rs10497667, respectively
  misc_feature [331]..[331]: n is a, t, c or g
cacagtgcctggcacattaagttggggtttaataagaatttgcttaatgttaaataattgacttttcagctgacagtttaaaagacgtgtagagattaaagacaagatggggaaggacatgataaatagagaaaacgatttctgcaaaaaaggtttaatgttgcactctgatatatgcagtagtttagtgagaccgatgaggccgaagcctcaggcaagtcttgactcctagaggccttgtacatcaagtgaggattttgagttttaccctgacatatatggagatcatatctgtattttagaaaatgactctggaataatttgcagaagnaaaagatggaatcatttgtgaacctgtcagaaggatacaataataatctatgcaaagaaagcctgaactgtggccatttcagaaagaagtgaggcatattggaaacaatttaggaggtgacaatttatctataacagaatataagacagaggaaagtgtctagacacatttttaggatactgtcatgaaaaagtcagttgataatgacaccatttgctgaaaatttaagaggaaattgcacaagaaagtggctgtagagtatttgtgtccccccaaattcatatgttaaaacctaattcccaatgtgttggtatttggaggtgtggccct

SEQ ID NO: 367 - DNA, 661 bp, Homo sapiens
  FLJ46536
  misc_feature [331]..[331]: Chromosome 2, SNP identification no. = rs4672870
  misc_feature [331]..[331]: allele = c, in linkage disequilibrium with rs4133195, respectively
  misc_feature [331]..[331]: n is a, t, c or g
gcctccctactccactggacttctttcccccatctctttctgtctcccttttttactcagtttctttgtgtctcatttgcttcttcctgttatgccacctctcaccctctcataatcacagctatcatttactaagcatttactacgtcccaggcactgctgtcggtgcttctgcgtaacacccttatgagatgagttctatagaacccccattttatagaggaggaagctgaggctcaaagatgctgcacaattcacccaccattggctagttagcgggggagctgagattcaaggcctgcagctgactccagaaccagtgggctcagangccccattcaggcagcatgtcgagtgcctgcacttcagtctctccgtttctcctgctcagtgtctctcaccatccagtgtcttcatcttccgtcatcacattgacctcaggggcccacagcacgctgtctgtctctaccatcccccctcagtcctcagtctctcaggtctcagtttctctctctctctctctctttctttttgtagagacgaggtctcactacatggtgcagactggtctcaaattcctaggctcaagcttcagccttccaaagtgctagggttgcaggcatgagccaccacacccagcccataatttattttttaaagt

SEQ ID NO: 368 - DNA, 661 bp, Homo sapiens
  FLJ46536
  misc_feature [331]..[331]: Chromosome 2, SNP identification no. = rs12694425
  misc_feature [331]..[331]: allele = c, in linkage disequilibrium with rs4133195, respectively
  misc_feature [331]..[331]: n is a, t, c or g
tcaccatccagtgtcttcatcttccgtcatcacattgacctcaggggcccacagcacgctgtctgtctctaccatcccccctcagtcctcagtctctcaggtctcagtttctctctctctctctctctttctttttgtagagacgaggtctcactacatggtgcagactggtctcaaattcctaggctcaagcttcagccttccaaagtgctagggttgcaggcatgagccaccacacccagcccataatttattttttaaagtctcttctcactgcagagatcttccgtggcctgactcagcctctctgtgtctctctcctgtggtctcngggtacgtcagtctgcccacctgcccctgtctctctctcccacatggctaacacctgccccaggtccaacagacaccagtcggaccccagcagagcctgagtagctgtgattcagcctgaatcactaggaagccttctggctgtctgcttcgcaggtgagagaggcccaggagcccagaaaccaacccaaaaggacccccaggctcctcccactccacactcagctgagcacacagtgtggtcgcaaaggtttccacgattcagggcaaaatgaacatgggggttctggccacacaagagtcttcaagggttcaagacagtctgggagga

SEQ ID NO: 369 - DNA, 661 bp, Homo sapiens
  FLJ46536
  misc_feature [331]..[331]: Chromosome 2, SNP identification no. = rs12694426
  misc_feature [331]..[331]: allele = t, in linkage disequilibrium with rs4133195, respectively
  misc_feature [331]..[331]: n is a, t, c or g
cctcaggggcccacagcacgctgtctgtctctaccatcccccctcagtcctcagtctctcaggtctcagtttctctctctctctctctctttctttttgtagagacgaggtctcactacatggtgcagactggtctcaaattcctaggctcaagcttcagccttccaaagtgctagggttgcaggcatgagccaccacacccagcccataatttattttttaaagtctcttctcactgcagagatcttccgtggcctgactcagcctctctgtgtctctctcctgtggtctccgggtacgtcagtctgcccacctgcccctgtctctctcncccacatggctaacacctgccccaggtccaacagacaccagtcggaccccagcagagcctgagtagctgtgattcagcctgaatcactaggaagccttctggctgtctgcttcgcaggtgagagaggcccaggagcccagaaaccaacccaaaaggacccccaggctcctcccactccacactcagctgagcacacagtgtggtcgcaaaggtttccacgattcagggcaaaatgaacatgggggttctggccacacaagagtcttcaagggttcaagacagtctgggaggagcagctgggaggttatagagagatggcctggccctggc

SEQ ID NO: 370 - DNA, 661 bp, Homo sapiens
  FLJ46536
  misc_feature [331]..[331]: Chromosome 2, SNP identification no. = rs10932745
  misc_feature [331]..[331]: allele = t, in linkage disequilibrium with rs4133195, respectively
  misc_feature [331]..[331]: n is a, t, c or g
agctgggaggttatagagagatggcctggccctggctgctccttttactggggaccctgtctcacagaccacagtgctccggccacctgtcactcatcattcagtcattccacaaacaccctgtgcacccactctgagccaggcctgtcctaggtatgggaaatcctctcacagacaaaacaggccaaacgcctgccctcatggagcttgcattctagtggaggaggcaataaaagtgattagcaagtaaagtacctaggatatcagattggaataagttctaagaagaagacataaagcagacaagaggaatgggacatgttggtgtggnattttacattttaataaggtaatatggccagggaagacctccctgtaaatgtgacattgacctaaagacctgaaggaagtgaagatcaagccctttgactattcggtagaatgttccaggctgcgagaacagcaaaaacaaaggccctgatggaggacgggcagggcaggttctaggaacatccaaggaggccttccgggccccagtagagtgagggagggagaggatgtgggaaaaggtcaggtgagccaaggaggcaggttagggagagcctgcgaggtcatcggaagtgcctcgactttgactcagaggaagatgggagccactgag

SEQ ID NO: 371 - DNA, 661 bp, Homo sapiens
  FLJ46536
  misc_feature [331]..[331]: Chromosome 2, SNP identification no. = rs11687200
  misc_feature [331]..[331]: allele = a, in linkage disequilibrium with rs4133195, respectively
  misc_feature [331]..[331]: n is a, t, c or g
gtggaactcaggagggaagtgtgcgctgggagatcgatcctggagtcctcagagtaaggatggtgagtaacagctgaccctgaggctcagaagaggatgtgctaccctgatgcctgggagccagggagctaaggacaaagctcactcccgggaaaggagcccgtgggcatcaagctggtgatgagttcctcaacacagagaatagaagtgccgagggacccattcattccatggacatttagtatgcttctacaatggccatgagcaggtgtggtgaacaaacttggcccagcctgctctagaagacctgggacagataaacagatagcantccaatggccattggatggatgctagggaaaaaaacaaaggcagggaagggcgcggagaaagacaggatagtcattcagactggggtccagaaagtcctctctgaggtgacatttgagcagaagccccaaccacatgaaagactggaccatgcaaatatctagtgagaagtgctgtggccaggggaatgtccggaagacatgcgtttgttgacaggcaggccagatgcatacggggtgtggctgagcagaggagagagcggcagagccggagccaggggcctcaaaggcagagtgaggcaccggaattctctgtgctaccagaggctggg

SEQ ID NO: 372 - DNA, 661 bp, Homo sapiens
  FLJ46536
  misc_feature [331]..[331]: Chromosome 2, SNP identification no. = rs11676275
  misc_feature [331]..[331]: allele = g, in linkage disequilibrium with rs4133195, respectively
  misc_feature [331]..[331]: n is a, t, c or g
cacagagaatagaagtgccgagggacccattcattccatggacatttagtatgcttctacaatggccatgagcaggtgtggtgaacaaacttggcccagcctgctctagaagacctgggacagataaacagatagcaatccaatggccattggatggatgctagggaaaaaaacaaaggcagggaagggcgcggagaaagacaggatagtcattcagactggggtccagaaagtcctctctgaggtgacatttgagcagaagccccaaccacatgaaagactggaccatgcaaatatctagtgagaagtgctgtggccaggggaatgtccngaagacatgcgtttgttgacaggcaggccagatgcatacggggtgtggctgagcagaggagagagcggcagagccggagccaggggcctcaaaggcagagtgaggcaccggaattctctgtgctaccagaggctggggcagggtttagagcaggggcgtttctccgtctgacttctgtgtttaaaggctcactcaggctgtggtgtggaggacagtggaagtgtggtagaagtcccgtgcagagcacaggctgggggcagaggtgagccacagctgacctgaaggcggcaggcttcaggcaggcccatggggctgtgaaaacggactttg

SEQ ID NO: 373 - DNA, 661 bp, Homo sapiens
  FLJ46536
  misc_feature [331]..[331]: Chromosome 2, SNP identification no. = rs12694427
  misc_feature [331]..[331]: allele = g, in linkage disequilibrium with rs4133195, respectively
  misc_feature [331]..[331]: n is a, t, c or g
ctctgaggtgacatttgagcagaagccccaaccacatgaaagactggaccatgcaaatatctagtgagaagtgctgtggccaggggaatgtccggaagacatgcgtttgttgacaggcaggccagatgcatacggggtgtggctgagcagaggagagagcggcagagccggagccaggggcctcaaaggcagagtgaggcaccggaattctctgtgctaccagaggctggggcagggtttagagcaggggcgtttctccgtctgacttctgtgtttaaaggctcactcaggctgtggtgtggaggacagtggaagtgtggtagaagtcccntgcagagcacaggctgggggcagaggtgagccacagctgacctgaaggcggcaggcttcaggcaggcccatggggctgtgaaaacggactttgggctaagacatggggcttccaacatccacctcacagctttctagctgtgggcccctggggacagtggtctgccctctctgggcctcaggtccctgatttgcaaaaggagacggtgggatagctaaggttcctcctcccagctcagatgctcatggggccatctttccaagcaggtgggtgtcctctgcgctgggaataagacctcaagccaaagaaattaggacaagcatcagccaa

SEQ ID NO: 374 - DNA, 661 bp, Homo sapiens
  FLJ46536
  misc_feature [331]..[331]: Chromosome 2, SNP identification no. = rs6737563
  misc_feature [331]..[331]: allele = t, in linkage disequilibrium with rs4133195, respectively
  misc_feature [331]..[331]: n is a, t, c or g
aagccaaagaaattaggacaagcatcagccaaagaggtcctcaggatggggaactaggcagatgtcacatgacccccagcccctgcacagcagcactgagctccttggagtcctgccaggctccatcagcatccttccctccctccctcccacctgctgcccacttggcaccagtgccaggaatcactggtgatcagggccttacctgggtgaaggtgtagggaggcaaaaagagttttgatctgggctggcctgtgtccagatttctgccccctccactcatcaagctatgtgaccctgggcaagtgtcaccccctctctgaggttctanttttctctcttgtaaaatgaggattatattatctgtctcctaacattgtgaaaactaaatgaatggggctataaaacaccaagctcaggcctggcatatagtaagtgctcagtaaactaattccttccatgcttccatgtcccctcgtgtgctaggagtatccatcaccccctgattaaaatacttcaggggctccccatttcactgagattaacatctacttttcctgggccactgacagacagctcaggtcctgcccacctccccactcttctcctaccttccctgccccccactgccctttgtggcagcccagattcactcatcttc

SEQ ID NO: 375 - DNA, 661 bp, Homo sapiens
  FLJ46536
  misc_feature [331]..[331]: Chromosome 2, SNP identification no. = rs13013361
  misc_feature [331]..[331]: allele = a, in linkage disequilibrium with rs4133195, respectively
  misc_feature [331]..[331]: n is a, t, c or g
ccgggaggaggaaatgttggctcatcccctccctctaaaggaaaactcaaggcagggccctgttttcatttctctgaatggttggtgaggagtcagttcgtaggtgtcaggccacacacactgtgcagttcagtgtgtggtgtgtatattgtatgtgtgtgtgtaaacgcacatacattgtgtgcatgttgtgttgtgtgtctgcattatggatgtctgttgtgtgtgttgtgcaagtgtgtgtttatatgttgtgttgtttgtgttctgtttatgtgtgtggtgtgtgcattatatatgtgttgtgtgtattgtgttgtgtgtgcgttangtctgttgagatgtgtcgtgtgttgtggtgtgtgtacgtattgcattatatgtataaattatatgcatgtagcattgtaagtgtgtcttctgtgttgtgcgtatgtgttctgttatactatgtgtgtattagggtgtgtgttgtgttgtaggcatgtgtgtgctgtgtgtgtgtgtgtttgtgtgtgtgtggacttcagctgccgggggcatcaccagcgtctcccatgggctccctctctggaagaggctcagcctagctcaggcacaaaggctgagctttgccccctgagaacctagtcttccttctgtacccaggtgtcaggaagag

SEQ ID NO: 376 - DNA, 661 bp, Homo sapiens
  FLJ46536
  misc_feature [331]..[331]: Chromosome 2, SNP identification no. = rs4133195
  misc_feature [331]..[331]: allele = t, c
  misc_feature [331]..[331]: n is a, t, c or g
ggaggacccaggaaccaggaagacgatgtcagatctgactgacgagggaccctaacgacgggtgaacagtagaacccttaagggaaaagaagagaggatccgatctcgataaaaaaaaggggacttaaggtgtagaagaggaaagaaccgaatgaaggaacaaaaagacctcgtgtaggagttgattgaaggatactttccgatacaccctccgtttaaaagactttagacagatacacttttacagaaatgaggtggtggagggggtgaattaagtaccaaacagacctttgttctaagatcccgttttcagtcaaaaagagtcttgaanttttcttaacgtggtatctgacaaatgtaccaacctaagatgaagaaaatatccactagacagaaaaaaagacctgttagaatcctgtaagaggaatagacagaatcactttaaagtattactacatagattgacacccgaaacaaacaaaacaaaaagtaaggaaacgagtcactttagaagtttagacttctagacacaggtagtctcgaccccttaagagagtgtagaattaaaaacgatacaaagtaaacaaagagaggagtgtcaatctttcctgtaaccttgagtctctgactaatagacatacagattaataaagagaggact

SEQ ID NO: 377 - DNA, 661 bp, Homo sapiens
  FLJ46536
  misc_feature [331]..[331]: Chromosome 2, SNP identification no. = rs6726126
  misc_feature [331]..[331]: allele = g, in linkage disequilibrium with rs4133195, respectively
  misc_feature [331]..[331]: n is a, t, c or g
agaatagaatccaatagaatgttctataaaggttgtatatttatgctgtccagtatggtagctgatagtcacatgtagagatggagcacttgaaatattgacctggtgcaactaaggaactaaagtttttattttatttattaatattttaattaaattaaatgtaaatagccacatgtggggtagtggctaccattttggatgctgtgagaaaagacggcaagttagaaggtggaggaaagaggtgagatgaaaggaagagatgctgcatcatcatattacagaacaggagtcataaggatactacctatagttagtagatgaagaaatnaatacatgagtatattctgtaaaaattacaatggtaggctaggcatggtggctcatgcctgtcatcccagcactttggaagtccaagtcaggtggatctcctgagttcaggagtttgagactagcctggccaacatgctgaaaccccatctctactaaaaatacaaaaattagccaggcatggtggcacatgcctgtaatcccagctacttgggaggccaaggcaggagaatcacttgaacccaggaggcagaggttgcagttagccaagatcatgccacagcactccagcctgggtgacagaggaagactctgtctcaaaaagaaaaaa

SEQ ID NO: 378 - DNA, 661 bp, Homo sapiens
  misc_feature [331]..[331]: Chromosome 2, SNP identification no. = rs10804264
  misc_feature [331]..[331]: allele = t, in linkage disequilibrium with rs4133195, respectively
  misc_feature [331]..[331]: n is a, t, c or g
aattttatgtaagtgaaatcatacagtatgccctctttattgcctgccttcttctgctgaacttaatgatgttgagattcgtgtctgttgctacatatatcaagaacatattttattgtcgagtggtattccaccgcatggatatgccacagtttgtctctacattcacctgtggatggacatctgagttgtttccaacctggggctattacaaataagattcacatgagtatctgctgacatacacttgtttctcttaggtttctcttgtgtagacatatacttgtttctcttaggtaaattcctaggaatgacatgggtgagtcattangtttaacttttttttttgagacggagtctcgctctgtcacccaggctggagtgcagtggtgtgatttcatctcactgcaagctccgcctcctgggttctcgccattctcctgcctcagcctcccaagtagctgggactacaggcggccgccaccacgcccggctaattttttgtatttttagtagagacggggtttccccatgttagccagcatggtctcgatctcctgacctcgtaatcagcccgcctcagcctcccaaagtgctgggattataggcatgagccaccgcgcctggccatgtttaacttttaaggaactgccaaactatt

SEQ ID NO: 379 - DNA, 661 bp, Homo sapiens
  misc_feature [331]..[331]: Chromosome 2, SNP identification no. = rs12694428
  misc_feature [331]..[331]: allele = g, in linkage disequilibrium with rs4133195, respectively
  misc_feature [331]..[331]: n is a, t, c or g
ctcagtgaagatggtgaggaggagatagtcaggagtgttcttaaggagaggaagagtaaggagcaggtacatttctggtttggcagatgattgaacaaggaaccactcaggagaaagacgtgtcaggaaatacaatgagattagttttctacatgctgaatttgcaaaatctgtaggccctcagggagatttaaggagataattgcatgtcagagtttggagcttaggggagacacttgttgggagcagtagctatgggagactctggcacatgtcggatggcagctgaagccatgaaaaccagtggactcaccaagagggggcagtagantgaaaagagaagaaaaccaaagtagaatcctcaggaacctcaatatttgaggaataagttaagaaatagagcaataaacaagacaagagaggtcaaggggaatagaggagaatgggttagtgggattcagtgatatagagatcaagtaagacctgaacggtaactttccaccataaataaagatgaaaagcatacagcaggcaggaagaaaatatcttaacataattgacaaatattcaaaacataattatataaagagctcctacaaatcagtaacaaaatcaatcaataacaaaataacaatccaaggctgggcatggtggttcacgc

SEQ ID NO: 380 - DNA, 661 bp, Homo sapiens
  misc_feature [331]..[331]: Chromosome 2, SNP identification no. = rs13035513
  misc_feature [331]..[331]: allele = c, in linkage disequilibrium with rs4133195, respectively
  misc_feature [331]..[331]: n is a, t, c or g
aacaactgttttgtcctgagatgctgttaatctgtaactttgccccaaccttgagcttataaaaacatgtgttgtatggaatcaaggtttaagggatctaaggctgtgtaggatgtgccttgttaacaaaatgtttacaggcagtatgcttggtaaaagtcatcgccattctccggtttcgataaaccaggggcacaatgcactgcagaaagccgcaggaacctctgccctggaaagccgggtatcatccaagatttctccccatgtgatagtctgaaatatggccttatgggatgggaaaaaccacactgtcccccggcccgacacccgngaaaggtctgtgctgaggaggattagtaaaagaggaaggcctcttgcagttgagataagaagaaggcctctgtctcctgcctgcccctggaaacggaatgtctcagtataaaacccgattgtacatttgttcaattctgagataagagaaaaactgccctgtggcaggaggcgagacatgttggcagcaatgctgctctgttattctgagatgtttgggtggagagaagcataaatctggcctatgtgcacatctaggcatagtatcttcccttaaccttatttgtgacacagattcatttgctcacatgttttcttgctgaccttctcc

SEQ ID NO: 381 - DNA, 661 bp, Homo sapiens
  misc_feature [331]..[331]: Chromosome 2, SNP identification no. = rs13007992
  misc_feature [331]..[331]: allele = g, in linkage disequilibrium with rs4133195, respectively
  misc_feature [331]..[331]: n is a, t, c or g
attgattttttgtatttctgtgtgatcggttgtaatatctccagtttcatttctaattgatcttattggatcttctctcttcttttcttggttaatcttgctaatggtctagcaatttggtttatcttttcaaagaaccagctttttgtttcatttatcttttatattgtttttgttttttcaatttcatttagttcttctctgatcttcattatttcttttcttctgctggacgtgggtttagtttgttcttgtttctccagttccttgaggtgtgacgttaggtcgtcaatttgtgctcttgcaaactttttgatataagcatttaacnctatgaaatttcctcttagggctgcttttgctgtatcccagaggttttgataagttgtgtcaatattatcattcatactaaagaattttttaatttccatcttgatttcattgctaacccaaaaatctttcaagagcagattatttaattcccatgtatttgtatagtttgagagttccttttggagctaatttccagttttattccactgtgctgtggtctgagaagatacttgctattttgattttcttaaatttattgagacttgttttgtggcctatcatatgttttgtcttggagaatgttccacgtgctgttgagaagaatgta

SEQ ID NO: 382 - DNA, 661 bp, Homo sapiens
  misc_feature [331]..[331]: Chromosome 2, SNP identification no. = rs7426289
  misc_feature [331]..[331]: allele = c, in linkage disequilibrium with rs4133195, respectively
  misc_feature [331]..[331]: n is a, t, c or g
tgtgtccagagtttctcccttccggtgggttcgtgatcttgctgacttcaggagtgaagccgcagaccttcgcagtgagtgttacagctcttaaaggtggcgcgtccggagttttttgttcctcctggtgggttcgtggtctcaccgacttcaggagtgaagccacagaccttcgcagtgagtgttacagctcttttttttttttaattttacattttgttttattttatcaaagttatgcttggttccagatctgtgagacaatatttttaatatggaaaacagaacatcaacaaaacaaacaagaaaatgacttgcagccttgaagtanactcagggcaaggtagtgtgggtgaccatctgattaaagaagctaagtcagagccagaaatcactttatgttttaagtataataatcaacaagtcagaatcacagccgataattaaacttcttaggcagttgcttcatcataacattcatttctgcatacatactttcaggttggaagtagaaattctcaaatgtctgaataaccaatatacaaaaacaattctgaagacgttaattaaagaagcaccttcaaacagtgttctctgattcaaaaagttttaaaaggggcttggatttggaggaatgcaggaggcagccagatggatgggg

SEQ ID NO: 383 - DNA, 661 bp, Homo sapiens
  misc_feature [331]..[331]: Chromosome 2, SNP identification no. = rs6436029
  misc_feature [331]..[331]: allele = g, in linkage disequilibrium with rs4133195, respectively
  misc_feature [331]..[331]: n is a, t, c or g
ttaaggatatgctcctgctgcagataactagccaaacccatccctttattttggcccattcctttgtttcccataaggaatacttttagttaatctataatctatagaaacaatgcttatcactggcttgctgtcaacaaatacgtgggtaaatctctgttcgaggatctcagctctgaaggctgtgagacccctgatttcccactccacacctctatatttctgtgtgtgtcttcaattcctccagcaccaccaggttagggtctccctgaccaagctggtcttggcaagtggcgtccatcatgggggcttgaatccaggtcgaaggtcnccggagcgacggttggagaacatggaactaagctggaggacaactgagtactgttaaagcaatccccatggtgagtaagaagaggagctcagaagcatcagggtaacaatgggacaagtgtgggctctggtttgttccaccttggaacattttcacactgatgatgaggaggaaggcgagtataacgaagtaacagaagaggttacagagcaggtttgtttgccggctaaaactaaagcagcaaaggaggtagaggttcatccctacccttctgcaccccctcattattattttaaagtaaaacagtggcctgaccttccagatctttct

SEQ ID NO: 384 - DNA, 661 bp, Homo sapiens
  IL8RB
  misc_feature [331]..[331]: Chromosome 2, SNP identification no. = rs4674257
  misc_feature [331]..[331]: allele = a, in linkage disequilibrium with rs4133195, respectively
  misc_feature [331]..[331]: n is a, t, c or g
tctcggctcactgtgacctccacctccccgattcgagtgattctcctgtctcagcctcccgagtagctgggattacaggcatgtaccagcacacccggctaattttgtatttttagtagagacaggatttctccatgttggtcaatctggtcttgaactcctgaccttaggtgatctgccagcctcagcttcccaaaatgctgggattacaggcgtgagccaccacgcccagcaactatgttttttttttatttctttttcttccctcttaaggatctgactttaatatttatagtttattttagcctaatttgatccttggtttttaggngtgaagacttttggattttaggagtgaagactctgtatgagttcgttagttagagacagtccttgtgtgctggctttcccagatcctggttgtagcagttacgtacttggtgtgtgggaaggtttactgtctcctacagggttggaatggcaggaatctctttaagcttacctcattctctcgtggggtactctttatttatttatttaatttttccccagtattttacttactgagttgattcaggctttggaccagtaggggaagtatccctgggtaggcaccagatgtagctaaagtaggtgggtaggcaccggttgtagctaaagc

SEQ ID NO: 385 - DNA, 661 bp, Homo sapiens
  IL8RB
  misc_feature [331]..[331]: Chromosome 2, SNP identification no. = rs4674259
  misc_feature [331]..[331]: allele = g, in linkage disequilibrium with rs4133195, respectively
  misc_feature [331]..[331]: n is a, t, c or g
cagacaagtccgttggcgggggctgggatgcctgcatcttccttgttaaaaaaggaagtgcaggttcaaaacattcagagacagaaggtggatagacaaatctccaccttcagactggtaggctcctccagaagccatcagacaggaagatgtgaaaatccccagcactcatcccagaatcactaagtggcacctgtcctgggccaaagtcccaggacagacctcattgttcctctgtgggaatacctccccaggagggcatcctggatttcccccttgcaacccaggtcagaagtttcatcgtcaaggttgtttcatcttttttttcctntctaacagctctgactaccacccaaccttgaggcacagtgaagacatcggtggccactccaataacagcaggtaggtgacttgttcagtctgagatgctggcaacatatttctaatggaagagatctggaaacttcagcctcctctgaggcccctgagaactggggtgatgaagtgtagaagcttagagctaaagacaactaagtcttcacctagacagtgttgcacaaaagaattttctgcaataatagaaatgtcctagacctgccctgcccagtatggtagccactagtcacacgtggccacggagcacttgaaatgtgactagtgt

SEQ ID NO: 386 - DNA, 661 bp, Homo sapiens
  IL8RB
  misc_feature [331]..[331]: Chromosome 2, SNP identification no. = rs6723449
  misc_feature [331]..[331]: allele = t, in linkage disequilibrium with rs4133195, respectively
  misc_feature [331]..[331]: n is a, t, c or g
aacatggtagagtatacgatgctatagcctactacacacatgggctatatggtagagtactgctcctaggctacaaacctactcagcatgttactgtactaaatactgtaggtaattataacacaatggtattcttatatataaacataggaaaagaacactaaaaatacagtattataatcttatgggaccactgtggtatttgtgatgtgtcattgaccaaaaagtctttcagttgctcatgactgttcctcaatttgtctgtccgttcatcagttgatggatatttggtttgtttccactttttggccttaatgatgaatgctactangaacattagctttcaattctcttgggtgtatacctaggttggggtttgctggttcatgtggtaactctatgtttaacttttttgagcaactgctaagctgttttccaaagcagctgcaccatcttacattcccacctgcaatgtgggagagttctgacttttccacttcctcacccacattgttcttgggcatctttttctgagtgtgcccagcctggtgagtgtgaagtgggttctgggacctttaacttcctggtttttctctcacactgggttccattttgggggtagattacggacttggacatggttggtggtagggtggtcatc

SEQ ID NO: 387 - DNA, 661 bp, Homo sapiens
  IL8RB
  misc_feature [331]..[331]: Chromosome 2, SNP identification no. = rs1126579
  misc_feature [331]..[331]: allele = t, in linkage disequilibrium with rs4133195, respectively
  misc_feature [331]..[331]: n is a, t, c or g
cgggctctggatgccaccgagattctgggcatccttcacagctgcctcaaccccctcatctacgccttcattggccagaagtttcgccatggactcctcaagattctagctatacatggcttgatcagcaaggactccctgcccaaagacagcaggccttcctttgttggctcttcttcagggcacacttccactactctctaagacctcctgcctaagtgcagccccgtggggttcctcccttctcttcacagtcacattccaagcctcatgtccactggttcttcttggtctcagtgtcaatgcagcccccattgtggtcacaggaagnagaggaggccacgttcttactagtttcccttgcatggtttagaaagcttgccctggtgcctcaccccttgccataattactatgtcatttgctggagctctgcccatcctgcccctgagcccatggcactctatgttctaagaagtgaaaatctacactccagtgagacagctctgcatactcattaggatggctagtatcaaaagaaagaaaatcaggctggccaacggggtgaaaccctgtctctactaaaaatacaaaaaaaaaaaaaaattagccgggcgtggtggtgagtgcctgtaatcacagctacttgggaggctgagatgg

SEQ ID NO: 388 - DNA, 661 bp, Homo sapiens
  misc_feature [331]..[331]: Chromosome 2, SNP identification no. = rs4674261
  misc_feature [331]..[331]: allele = g, in linkage disequilibrium with rs4133195, respectively
  misc_feature [331]..[331]: n is a, t, c or g
cccttctggcccctcactgacctggaaatgtgaaaggaagagaatttggggaaatacagttctatcctatctatgctgactcaatacaaatcctctgcacaaacttatgtgcgaactctaaagaaaaagaacggttcccacaaaggttcaggtgatatttattaaagggtcgggaaagggaggaacacatgggggctttagggggcactgataatgtcctctctcttatcctatgtgatagatgcttaagagccattatattattattttttaagctataaatgttagttttctgtaatctgtgctatgtatgctattcacaagaaaagtntttttaatcattaaaatgaagggaaaaaatacagaaacagtgatcagaacaaaaggacaacctgggtcatttcaaggaaccaccacagggagtggactgcaagcttttgtgttgtatagtttggggatcagaattcaccagactagaagatattatcatccactgccagtaggagaggaattaggaacgatccttcaagaaggcaattttgtgatatatactttaatgcatacaatctccaatccaggaattatacactgctacaaatctatcctatagaaatacacatctaggcggacaaacgtgtacaggatattcatcacagcattt

SEQ ID NO: 389 - DNA, 661 bp, Homo sapiens
  misc_feature [331]..[331]: Chromosome 2, SNP identification no. = rs11677534
  misc_feature [331]..[331]: allele = t, in linkage disequilibrium with rs4133195, respectively
  misc_feature [331]..[331]: n is a, t, c or g
ctggtttgtacaattttgcattgtttccatttatttggttggggctggatttttccaaaaatgaaggagctgaagctgattttggaggggtctgcacaggccttcttatagacaagggggctgggctttgtggacatgaccatttctgtgttttatattctttcttgaacaatattcatattcttttttttacttgatttcctggtgaagttgctttttgaaaaacatcttcttagtcccaaatgagttaagcaataaagagacttgttgatatttgaccaaaaaagaactaggcaccactgatggccatgggacagcatttctaaaatgntccatgcttaaaatgggcttcttgtccaggtggttcctgcctgtaattcctacactttgggaggccaaggcaggaggaggattgctagagctcaggagttcgagaccaccctgagcatcagtgagaccccatctctacaaaaaatgtttaaaattagccagacatggtggcatacacatctagtcctagctactcaggaggctgagatgggaggatcatttaagcccaggaggtggaggctgcagtgagctgtgatcatgccactgcactccagctgggacaacagagcaagaccctgtcttaaaataaaataaaatataataaaatggg

SEQ ID NO: 390 - DNA, 661 bp, Homo sapiens
  misc_feature [331]..[331]: Chromosome 2, SNP identification no. = rs13009946
  misc_feature [331]..[331]: allele = t, in linkage disequilibrium with rs4133195, respectively
  misc_feature [331]..[331]: n is a, t, c or g
tccccagtttcctggcagaaactaggcagtgcacttgagctaggcaaggagagagagttttatccacttcagtaagagttgaataaagggacctggaacaacagtgtgggaaggatttggggaaaataatgtgaaattcagtaccctaaggactgtgacagtggggagcaatcactatccctaggcctaaagcagcaaggtgaggaaccatgacaggagcccaagagagagcagtatgatgtgggctgcctgacaggtgtcaaccccagcaaccagcagggacagggctgagcaaagaaatgccctgacttgacactgctcctgtttaggnttcctgaagcctctcttaccagggttcccattggctgaactcagtcccgtctcccacttggatccccctgatactgggttgagctcaacccaatctcctaccagtgaaagaggaggagttcccttatccccctcatgaggcatacaacaggggtgtgtctcgcttcttcagtgccccaccactcaaaccttgagggggagcatgcaggtgggcaggtcgtggggagcatttttgggctccgacaccatgacagcacctagggttgagtgtttacagctcccaaaaccccagtgggcatgtgttacactgtgctctttcagttttgccatc

SEQ ID NO: 391 - DNA, 661 bp, Homo sapiens
  misc_feature [331]..[331]: Chromosome 2, SNP identification no. = rs7594532
  misc_feature [331]..[331]: allele = t, in linkage disequilibrium with rs4133195, respectively
  misc_feature [331]..[331]: n is a, t, c or g
cctgacaggtgtcaaccccagcaaccagcagggacagggctgagcaaagaaatgccctgacttgacactgctcctgtttaggtttcctgaagcctctcttaccagggttcccattggctgaactcagtcccgtctcccacttggatccccctgatactgggttgagctcaacccaatctcctaccagtgaaagaggaggagttcccttatccccctcatgaggcatacaacaggggtgtgtctcgcttcttcagtgccccaccactcaaaccttgagggggagcatgcaggtgggcaggtcgtggggagcatttttgggctccgacaccangacagcacctagggttgagtgtttacagctcccaaaaccccagtgggcatgtgttacactgtgctctttcagttttgccatctgcaggtggcttgtgttaatcagctcaattagatcctctgccttatcacaaggacagagggctttctgtaacccaagttcttgccctagtgtaccagaaaaatcagatcacacatgggcttggaggatgggtgcaaggttttattgagtggtggaggtagctctcagagaggtggatggggagccagaaggaggatggagtgggaaggtggtcttcccctggagtcaggctgcccagcagccagactt

SEQ ID NO: 392 - DNA, 661 bp, Homo sapiens
  misc_feature [331]..[331]: Chromosome 2, SNP identification no. = rs7607437
  misc_feature [331]..[331]: allele = a, in linkage disequilibrium with rs4133195, respectively
  misc_feature [331]..[331]: n is a, t, c or g
tgctctttcagttttgccatctgcaggtggcttgtgttaatcagctcaattagatcctctgccttatcacaaggacagagggctttctgtaacccaagttcttgccctagtgtaccagaaaaatcagatcacacatgggcttggaggatgggtgcaaggttttattgagtggtggaggtagctctcagagaggtggatggggagccagaaggaggatggagtgggaaggtggtcttcccctggagtcaggctgcccagcagccagactttcctcctaccacccccaactgaattccatgttgtcccaccgtcaatggcctgccggtgttcnctggtgtctgttggtgtgttgttctgctcctcttgatgtcctgctacttgtgtgtgtacccgctaaggtctctcgggtttatatgggcacaggatgggggacgtagggggccagagtgggcttggaaaatgcaacaggaatggctctcctcatttaggtccatggacacaggcccagtgtggagccctcaccagggaccccacccttctctacccagcacttccctgccccactcccatatcaccaggattcccattggttgagctcagaaaccagaggacaagggagtgccctgagacagtccatgtaggtcagcatcccagggcacag

SEQ ID NO: 393 - DNA, 661 bp, Homo sapiens
  misc_feature [331]..[331]: Chromosome 2, SNP identification no. = rs11676348
  misc_feature [331]..[331]: allele = c, in linkage disequilibrium with rs4133195, respectively
  misc_feature [331]..[331]: n is a, t, c or g
cctagccaaaaagaagatggccttgcattggagcctcttgtggtcattctgtcttccctaggtggagcagctatgggagtccagagggaaaacagagaggagcagaaatcatggccccaactcaagggccctcccctaaggacagcttcagagacataaacaaaggagcaccttccgggagaagacaaacacaccactgatttctcaacagggccttgctaggtctgatgtcagacatgttccctgctcataaacagaagagccagcttcccatcaacactggctctgtgccaggcagacccagagacagggctaaagtcctggttcccangaggtggtcagtgttttttctctattctgctacagttatgatcccagcgggcatttctagaggactttcttagaagtccagcaccatgctaagggatttgctctactggactgcacagctgtctatggcacttggaatacctcgcttccccatgcttaattccatgcttgcccaacagtccaacccaattgccaaaaatccataagcaggggagacagggagcttctgcaaggctcaggggtctcaatatcatagtagttcccagggaccatggtcaggggtgcccagaaaccctctgtttatggaaagattctactcattcagtttagg

SEQ ID NO: 394 - DNA, 661 bp, Homo sapiens
  misc_feature [331]..[331]: Chromosome 2, SNP identification no. = rs13027120
  misc_feature [331]..[331]: allele = t, in linkage disequilibrium with rs4133195, respectively
  misc_feature [331]..[331]: n is a, t, c or g
cctgatctcagatgatccgcccacctcagctcccaaagtgctgagattccaggcatgagccactgagcctggcccattactttgttttaagacctagcacggagttggatgcaaacaagcatttgttacataatcagacaactagcggattctcacttaggaacatgtgggaatgtgcacaaagacagtacatgctgagtcttgccagggtcccactcagaggagtgctcaagtatgctggccaagtggggaaccctgcactgcacagccctgagacctgtacctgcctagtctccccacacccccaatacctttaaagctggagcaaagncacctctttcaggaagacagccatgttgtttacagtatgggaaccaagggagaggtacggatgtggcctcttaggtttcagttgggcaacacaattccttcccatgtcggaagtgactagatttcttcagcggtccctccccatttaccttctagatcttacttcttccatccccctgatgcaagcctggctaaaaaaaagggggtgatagttctggaataacgttgggtcattcatccccaaaacagacatacatatgcacccatgcataagcaacatgcacgtacacactgtgggttacctagaaatcccgtcaatgtatcctcctgg

SEQ ID NO: 395 - DNA, 661 bp, Homo sapiens
  misc_feature [331]..[331]: Chromosome 2, SNP identification no. = rs1008563
  misc_feature [331]..[331]: allele = g, in linkage disequilibrium with rs4133195, respectively
  misc_feature [331]..[331]: n is a, t, c or g
ttagtttcgaccctacccccgtccctaccccaccgtcgaaccctactccagtctcttcctacttacggtccttagccatctctagatgttcctccctctcactctcagtcccagtgtcactccacaacccttgtccctctaagttgtacctcgaccctggtctatacctctcactctgaaaccttaccctattcacaccccctcaccactccgagtccctcccccacagtccggaccttacttatagtcccttccgaatcatcgatattccgacctcgtcttctgcacggaccatcccagtggtaggatagacctcgtagtagattctagnagaaggccccggttttctgtctccgaggagtcagacaggacgaattctgagaggtccgtccactcactcctccctcaatccgtgagctcgggattctctatctggactaagtcgtctcttctgttcttcctacgtttcctacgtgtctcttagatcccgtcttccgactcttgaccccggaggaaaaggagaggagggaggcgactagagggaggtggagaggatgacaaaggagtttcaggttgaaggaggaagaagtggaatacgaggacgttcctgttgaggtagtctccgaagtcattcatttatccctaggtgtgacccaggtcc

SEQ ID NO: 396 - DNA, 661 bp, Homo sapiens
  misc_feature [331]..[331]: Chromosome 2, SNP identification no. = rs1008562
  misc_feature [331]..[331]: allele = c, in linkage disequilibrium with rs4133195, respectively
  misc_feature [331]..[331]: n is a, t, c or g
ccttccgaactccaacccttatcccactccgagtctctgtcctggatctagttcgaagtctacccctagtcactaactacaactttagtttcgaccctacccccgtccctaccccaccgtcgaaccctactccagtctcttcctacttacggtccttagccatctctagatgttcctccctctcactctcagtcccagtgtcactccacaacccttgtccctctaagttgtacctcgaccctggtctatacctctcactctgaaaccttaccctattcacaccccctcaccactccgagtccctcccccacagtccggaccttacttatantcccttccgaatcatcgatattccgacctcgtcttctgcacggaccatcccagtggtaggatagacctcgtagtagattctaggagaaggccccggttttctgtctccgaggagtcagacaggacgaattctgagaggtccgtccactcactcctccctcaatccgtgagctcgggattctctatctggactaagtcgtctcttctgttcttcctacgtttcctacgtgtctcttagatcccgtcttccgactcttgaccccggaggaaaaggagaggagggaggcgactagagggaggtggagaggatgacaaaggagtttcaggttga

SEQ ID NO: 397 - DNA, 661 bp, Homo sapiens
  misc_feature [331]..[331]: Chromosome 2, SNP identification no. = rs4674267
  misc_feature [331]..[331]: allele = c, in linkage disequilibrium with rs4133195, respectively
  misc_feature [331]..[331]: n is a, t, c or g
gcaggtgataaagttcccttgttgggactcttttgtggaatcaatggctataaatggtgaagaacgttcgcactgcaaatacagtgttctcatctcaaagcaaactatacttcccaaggaaaccatgtatgtcagggcaagaggacaacaccattttgtatcaggatgtgtccctcatgccctgaagcgaggcttctcttagcttccccaccagtgacaggtaacagctcctgttctcagctgccctggctgagctaatccatgaatgcttacctccctgaggaggctgcctcacatcacacccctgagcggaggaagtatcctacttccnatcaaaggacctctctgccaacaaacagaactgttgcctctgccacagctcttttggccaaactggggatgtccggtgggagttgccccacattcccctctcctctgcttctgaatgcctttgtcatacaaagggcaagggaagccaacatccagagctcttttgctggtcagagattccccgagtgtctgtccttaccccagtctgctgcatgtgtctgtgtcataaagcttgggactctggtgggaaatggggaaacgaggataggtaaatgttgccctaagaatgagtctcattcctctgttcttgttgggatgtgttcttgggaag

SEQ ID NO: 398 - DNA, 661 bp, Homo sapiens
  misc_feature [331]..[331]: Chromosome 2, SNP identification no. = rs13397673
  misc_feature [331]..[331]: allele = a, in linkage disequilibrium with rs4133195, respectively
  misc_feature [331]..[331]: n is a, t, c or g
ggaggcggaggttgcagtgagccaagactgtgccactgcactctagcctgggtgacagagtgagactctgtctcaaaaaaaaataataaataaataaaaattttaaaaaaatgaaaagaggcttacaatttcattttgtaatgggtactgaaaattatgtagccagtcttgatgccagttaaatatgtgttagatagatgaaatactgaaggagtggagaggagaaacagcagaacagaattctcatcttagctcaatggatggcaactattcttccaattgccaaaactcatggactcatcgctgatgcatctttatctcttacactcancagtcaatccaccagaaactgctgctgactctgccaaagtaaattgcagctcctgttttctcaccaactccactgctattgccctatcttctgccacccagtgtcccttctcacctatatcattgaaacaaccctgctcatccctgctcccacccattgtgttctgtggtatattctcatcacaccagagggagcaatccttttacaatgcatgtcagatcattgtcactccttcttagtatactgcaactgaagcaggatatttccctgacccctttgcaggtgggaactggagtgtaggtgctggaattagccagctgctttggcgtt

SEQ ID NO: 399 - DNA, 661 bp, Homo sapiens
  misc_feature [331]..[331]: Chromosome 2, SNP identification no. = rs12694839
  misc_feature [331]..[331]: allele = g, in linkage disequilibrium with rs10498243, respectively
  misc_feature [331]..[331]: n is a, t, c or g
aatctcaccttgaattataataatctccacctgtcaagggtgacaggtgtagataattgtatcatggggggtggttcccccatactgttctcgtggtagtgaataagtcttgtgagatctgatggttttataaatgggagttccccagcacaagctatcttgcccaccactgtgtaagacatggctttctcctcctttgtcttctgccatgattgtgaggcctcctcagccatgtggaactgtgagtctgttaaatctctttttctttataaattacccagtcttgggtatacctttattagcaatgtgagaactgaataatacagtagcnctgactttataggcttgttgtacagattaaagaagtcagcactcactaaaactgtgtcacagtaaacaacccagcacatattttctatggttatgttttgtatgggtcatcaacctcttgtgctctcttccagtctagccccatctctcacatccagtgcccccttggttttctcctgaaggggggtgtctttagcaatggtggtgggcttacagtggccttacagtccctcagagatgagagaagtgagaaatttccccagcctggtgccccagcgcctgtgatgaggccaagtgtattagtccattttcacagtgctggtaaagacaa

SEQ ID NO: 400 - DNA, 661 bp, Homo sapiens
  misc_feature [331]..[331]: Chromosome 2, SNP identification no. = rs12694840
  misc_feature [331]..[331]: allele = g, in linkage disequilibrium with rs10498243, respectively
  misc_feature [331]..[331]: n is a, t, c or g
tcgtggtagtgaataagtcttgtgagatctgatggttttataaatgggagttccccagcacaagctatcttgcccaccactgtgtaagacatggctttctcctcctttgtcttctgccatgattgtgaggcctcctcagccatgtggaactgtgagtctgttaaatctctttttctttataaattacccagtcttgggtatacctttattagcaatgtgagaactgaataatacagtagcgctgactttataggcttgttgtacagattaaagaagtcagcactcactaaaactgtgtcacagtaaacaacccagcacatattttctatgnttatgttttgtatgggtcatcaacctcttgtgctctcttccagtctagccccatctctcacatccagtgcccccttggttttctcctgaaggggggtgtctttagcaatggtggtgggcttacagtggccttacagtccctcagagatgagagaagtgagaaatttccccagcctggtgccccagcgcctgtgatgaggccaagtgtattagtccattttcacagtgctggtaaagacaacctgagactgggaagtaaaagaggtttaatggacttacagactcagttctacattgctggggaggcctcacaatcatggcagaaggcaaa

SEQ ID NO: 401 - DNA, 661 bp, Homo sapiens
  misc_feature [331]..[331]: Chromosome 2, SNP identification no. = rs6706782
  misc_feature [331]..[331]: allele = c, in linkage disequilibrium with rs10498243, respectively
  misc_feature [331]..[331]: n is a, t, c or g
acatgagggaattgtgggagttacaattcaagatgagatttgggtggggacacagccaaactatatcattccaccccgacccctcccaaatctcatgtcctcacatttcaaaaccaatcatgctttcccaacagtccccaaattcttaactcatttcagcattaactcaaaagtccacagtccaacatctcatctgagacaaggcttttctgcttatgagcctgtaaaatcaaaagcaagttatttacttcctagatacaatggaggtacaggcattgggtaaatacagctgttccaaatggaagaaattggccaaaacaaaggggctacngtccctattcaagtccgaaatccaacaagtcagtcaaatcttaaagctccaaaatgatctcctttgactccatgtctcacatccgggtcacactgatgcaagaggtgggttcccatggtcttgggccactctgcccctgtggctctgcatcctccctcctggctgctttcacaggctagtgttaagtgtctgccactttttcaggcacacaatgcaagctgttggtggatctaccaatctgtggtctggaggacggtggccgtcttctcacagctccattaggcagtgccccagtagggctcccccacccacatttcccttctgcactgc

SEQ ID NO: 402 - DNA, 661 bp, Homo sapiens
  misc_feature [331]..[331]: Chromosome 2, SNP identification no. = rs6707129
  misc_feature [331]..[331]: allele = c, in linkage disequilibrium with rs10498243, respectively
  misc_feature [331]..[331]: n is a, t, c or g
tggccaaaacaaaggggctaccgtccctattcaagtccgaaatccaacaagtcagtcaaatcttaaagctccaaaatgatctcctttgactccatgtctcacatccgggtcacactgatgcaagaggtgggttcccatggtcttgggccactctgcccctgtggctctgcatcctccctcctggctgctttcacaggctagtgttaagtgtctgccactttttcaggcacacaatgcaagctgttggtggatctaccaatctgtggtctggaggacggtggccgtcttctcacagctccattaggcagtgccccagtagggctcccccacncacatttcccttctgcactgccctggcagaagttctccatgacaccaaggtggcaattgccctccatggaaggaagctgtctcactctgcccaaactccctgacacgtctctgctgctggcctggaggtgcacaggacagagaggagtctctttcagagacgtcatgatagtggctctagaatttagaccagacagttcaactagagagcccactctttaaggcaccaggccaggagtccccacataagtgatggttgacatccaatggctatgaagggctcagcacacagattcatcagcctcctggagaaatgactcaaggtgcatgt

SEQ ID NO: 403 - DNA, 661 bp, Homo sapiens
  misc_feature [331]..[331]: Chromosome 2, SNP identification no. = rs10933323
  misc_feature [331]..[331]: allele = t, in linkage disequilibrium with rs10498243, respectively
  misc_feature [331]..[331]: n is a, t, c or g
aatctgtggtctggaggacggtggccgtcttctcacagctccattaggcagtgccccagtagggctcccccacccacatttcccttctgcactgccctggcagaagttctccatgacaccaaggtggcaattgccctccatggaaggaagctgtctcactctgcccaaactccctgacacgtctctgctgctggcctggaggtgcacaggacagagaggagtctctttcagagacgtcatgatagtggctctagaatttagaccagacagttcaactagagagcccactctttaaggcaccaggccaggagtccccacataagtgatggtngacatccaatggctatgaagggctcagcacacagattcatcagcctcctggagaaatgactcaaggtgcatgtactgttgcagagccaccagagccatcttttcatactgatgtagaaataaagaccaaccagatgagaacaagcaaaggctatgtattcagagcttggattttggcagagacccaaaggcaggcagagtgaggaagcttcataatggaaaaaagggaaggcttcaggtgtgccttgattggaggctgttaacgtggggaagctgtgggcagttaagtagaaacaggacatcctatgtgataggttaggggagcatattt

SEQ ID NO: 404 - DNA, 661 bp, Homo sapiens
  misc_feature [331]..[331]: Chromosome 2, SNP identification no. = rs10933324
  misc_feature [331]..[331]: allele = t, in linkage disequilibrium with rs10498243, respectively
  misc_feature [331]..[331]: n is a, t, c or g
aaggtggcaattgccctccatggaaggaagctgtctcactctgcccaaactccctgacacgtctctgctgctggcctggaggtgcacaggacagagaggagtctctttcagagacgtcatgatagtggctctagaatttagaccagacagttcaactagagagcccactctttaaggcaccaggccaggagtccccacataagtgatggttgacatccaatggctatgaagggctcagcacacagattcatcagcctcctggagaaatgactcaaggtgcatgtactgttgcagagccaccagagccatcttttcatactgatgtagaaanaaagaccaaccagatgagaacaagcaaaggctatgtattcagagcttggattttggcagagacccaaaggcaggcagagtgaggaagcttcataatggaaaaaagggaaggcttcaggtgtgccttgattggaggctgttaacgtggggaagctgtgggcagttaagtagaaacaggacatcctatgtgataggttaggggagcatatttagctctctctgactggtcctaagttggaaatttggatttaggaaagctgtcagttattaatcaagtcctggcccttgggggtgggttattacaggggctattgtttgcttcctggattgt

SEQ ID NO: 405 - DNA, 661 bp, Homo sapiens
  misc_feature [331]..[331]: Chromosome 2, SNP identification no. = rs1529377
  misc_feature [331]..[331]: allele = g, in linkage disequilibrium with rs10498243, respectively
  misc_feature [331]..[331]: n is a, t, c or g
acgtgttaattttaatcatcgtcgtgtacggtgtccaattctcggtcgtactctacgggtggacacgtatcaccgtaaactttgctcgagacagacgtctcgtccgtcgggtcgtttcctctttaaacgtgtcactcctgttatgatggtgtctttcaccgagtcttatgaaaaacatgtgcaccatagaggtcctcccaacctatagacgttttagcaactccggaccaaaataacggaaattaaatacatattctggagtccttctaatcattaaataagtcatagtatgtacgtctttcttagagggtcagaggtttaagtgtaaagnagagtcttcgtataaacgtatctagttctcgaacaccgttggtttgaatacattaatcgagggtagatatgtacaaatgaggtgaatcggtgtaagaatctcggaagaagaagactttaagattttaccctttgtggacgaaggaagaccgggttttacaatgaaaccaaagtcgaaactttattctggacctcggttctctgaagtcgttttttaatgtaatataggtgttcatgggactgttttattttccgtcggtgacggtaagagacgttttcaggacgtccttcgtctacccacaattcctgaccgggtctaaatatgtgcttg

SEQ ID NO: 406 - DNA, 661 bp, Homo sapiens
  misc_feature [331]..[331]: Chromosome 2, SNP identification no. = rs12694841
  misc_feature [331]..[331]: allele = t, in linkage disequilibrium with rs10498243, respectively
  misc_feature [331]..[331]: n is a, t, c or g
aagctcttgatctatgcaaatatgcttctgagaggaaatgtgaatttggagactgggagattctttctgcatgtatgatactgaataaattactaatcttcctgaggtcttatacataaattaaaggcaataaaaccaggcctcaacgattttgcagatatccaaccctcctggagataccacgtgtacaaaaagtattctgagccactttctgtggtagtattgtcctcactgtgcaaatttctcctttgctgggctgcctgctctgcagacagagctcgtttcaaatgccactatgcacaggtgggcatctcatgctggctcttaaccngtggcatgtgctgctactaattttaattgtgcaagtctctttactgcttacaaaatggattttcacccttggaatagtatcaaggtcctccagatctggtcctggccttagtccgtccctagtgctctaaacaagtccttactctcacaaaacccagatatatactcattgtctcctgaacataccaagtttggtttcacttgggctctcacagttttcctttgcctggaatctgcgtggctccttttccctccccaactcacgcctgaccctgctttgctctggtttttatccacgaaaggcctgattcaagcctcacctcctccagga

SEQ ID NO: 407 - DNA, 661 bp, Homo sapiens
  misc_feature [331]..[331]: Chromosome 2, SNP identification no. = rs10498243
  misc_feature [331]..[331]: allele = c, t
  misc_feature [331]..[331]: n is a, t, c or g
cataaattaaaggcaataaaaccaggcctcaacgattttgcagatatccaaccctcctggagataccacgtgtacaaaaagtattctgagccactttctgtggtagtattgtcctcactgtgcaaatttctcctttgctgggctgcctgctctgcagacagagctcgtttcaaatgccactatgcacaggtgggcatctcatgctggctcttaacctgtggcatgtgctgctactaattttaattgtgcaagtctctttactgcttacaaaatggattttcacccttggaatagtatcaaggtcctccagatctggtcctggccttagtcngtccctagtgctctaaacaagtccttactctcacaaaacccagatatatactcattgtctcctgaacataccaagtttggtttcacttgggctctcacagttttcctttgcctggaatctgcgtggctccttttccctccccaactcacgcctgaccctgctttgctctggtttttatccacgaaaggcctgattcaagcctcacctcctccaggatgtcttctctgactgtatcagaccatggtgatctgattccttttatttctgaacaactctcccatagcacacttgactttcttattcttttggtaagtgggtaaaactatacat

SEQ ID NO: 408 - DNA, 661 bp, Homo sapiens
  misc_feature [331]..[331]: Chromosome 2, SNP identification no. = rs6715536
  misc_feature [331]..[331]: allele = g, in linkage disequilibrium with rs10498243, respectively
  misc_feature [331]..[331]: n is a, t, c or g
tctgcagacagagctcgtttcaaatgccactatgcacaggtgggcatctcatgctggctcttaacctgtggcatgtgctgctactaattttaattgtgcaagtctctttactgcttacaaaatggattttcacccttggaatagtatcaaggtcctccagatctggtcctggccttagtccgtccctagtgctctaaacaagtccttactctcacaaaacccagatatatactcattgtctcctgaacataccaagtttggtttcacttgggctctcacagttttcctttgcctggaatctgcgtggctccttttccctccccaactcacncctgaccctgctttgctctggtttttatccacgaaaggcctgattcaagcctcacctcctccaggatgtcttctctgactgtatcagaccatggtgatctgattccttttatttctgaacaactctcccatagcacacttgactttcttattcttttggtaagtgggtaaaactatacatgatgtttttggttatctatatcatattctgcatcttccactggacagtaagcttcagtatgtcagcaactttttttttttttccacacaggatctcactctgttgcccaggctggggtgcagtggtgcaatcatggctcactgcagcctc

SEQ ID NO: 409 - DNA, 661 bp, Homo sapiens
  misc_feature [331]..[331]: Chromosome 2, SNP identification no. = rs1549567
  misc_feature [331]..[331]: allele = c, in linkage disequilibrium with rs10498243, respectively
  misc_feature [331]..[331]: n is a, t, c or g
tccgggaacgttcttctgttttgttggaaacgaggacttaaaggtcaaggtgactctacgggacgttaaagacaggagcctaagacttttatactatgtggggagataataaacttgatagaatttactcaaagataaggaagtgagacaggacatctgaagtttcatattttttacccgggacttctccgtgttatttaatataactaaaggatttcccgtatagtgttacctctatgttgataaaattgaaggactcttagactttacagtattgagaaatactttagggagtgacttccgtattaaaaggggggacccataacacaanaggagaaaaactccttttgaaagaaaaaagactacctaaaaaccacggtaacagaacaaaaacttgaggtccgtaaataaaagagaagagaggtcgagaagtctctccttgacttaacattaccagtaacagtaacactttcagtagtagaaacttgacgtccacagaaaattccagtctgaaaaactagttctagattgtgtttttggagaattataattcgtccttttacgtatagacgagggtagttcaggaaaaaggacttagcgagtgacagtctcgtgtgggactttggcagaaccgtggtggtatctttgactctcgggatta

SEQ ID NO: 410 - DNA, 661 bp, Homo sapiens
  misc_feature [331]..[331]: Chromosome 2, SNP identification no. = rs6721137
  misc_feature [331]..[331]: allele = t, in linkage disequilibrium with rs10498243, respectively
  misc_feature [331]..[331]: n is a, t, c or g
tggcaacaacaatgatgctataatttgggtgttctcccaggctgccacacagtggcattgctgtgcacacttgagaaaactttatgaagttaccatgcacagcttgtcattttggtggtcccattccctcagcaaccctgagatcccagtatcttcctagatactagaaaaggatgcataagcggtaaaaccttgacctgaatttgagcaattttctaagtacaaagagtatatctttcaaacctttgcatgtgtgtggataatttgtgtatatgtccctcctctgaaatattaatataaataacacccagaatctgatattcataggttnggggaaagtgtgtggggtatttttctttgctttaaatctggtgggttttggcatttttgcattttcccagtgttttaatcctctgatctatgggctctggaataaagagctgcaaagcagattacaccattggatgtgttgtcagctatggtgtggtcacactgtcaacagcagagggctagtttagaaaaaaaactcagccatttgaatcaataactctagtcctaatggtctcatcagctaaggctgaggacctgtctttcactcaacctaaaattggtgccttcatttgattttgaaagaaatatgagtaagtcaaagttatttgtt

SEQ ID NO: 411 - DNA, 661 bp, Homo sapiens
  misc_feature [331]..[331]: Chromosome 2, SNP identification no. = rs1365775
  misc_feature [331]..[331]: allele = c, in linkage disequilibrium with rs10498243, respectively
  misc_feature [331]..[331]: n is a, t, c or g
acggacattcgggtcgatgaaccccccgactcagacctcctagtgaactccgaccctccagttccgacgtcactcgacactaacgtggtggcgtgagtccagatccactgtctcggtctgggacagaatttctttttctttttttttagatagagattgaaaaccttcggtgacaataaaacaacgacataaaaataatatacgtcgacttaggtgggaattaatcatattacccttttcggtttgaagaagggaagtgtaattggtacctgataaagagtcaaagatttttgttcatataagggttctggacggattgacgagtatgtgncatctcgtgtgacgatttttgtgaccggacccaaatttcaatttctgtaattttcctaaagtgacttcggttaagtcacatgtgtcatcagttcaaacattcggtttgtttattgaaactgaatgagtataaagaaagttttagtttacttccgtggttaaaatccaactcactttctgtccaggagtcggaatcgactactctggtaatcctgatctcaataactaagtttaccgactcaaaaaaaagatttgatcgggagacgacaactgtcacactggtgtggtatcgactgttgtgtaggttaccacattagacgaaacgtcgaga

SEQ ID NO: 412 - DNA, 661 bp, Homo sapiens
  misc_feature [331]..[331]: Chromosome 2, SNP identification no. = rs10933326
  misc_feature [331]..[331]: allele = a, in linkage disequilibrium with rs10498243, respectively
  misc_feature [331]..[331]: n is a, t, c or g
aatgttgggattacagatgtgagccacagtgcccagccgttttttttttcttatgtaaaacaaacctggaggtacataatccaggcctgtgtggccactccacagtcaacaagctcattctcttctgttgtgccatgattactgtgccacctcatgactcaagatggctgttagtgtgcctatcatcacaggcacactccaacagaaagcaggaaggagcaaagaagggtcggcacctttcttctgtagacacttcctagaagttacacaaaatacttactttttcttatgtcaaattggtcaacatttagtcacatgggtatgcctagtnatatggtttggctctgtgtccccacccaaatctcatgttgaatcataattcccaatgtttggggagggacctggtgggaggtgattggatcgtggtggtggatttcccccttgctgtttttgtgatagtgaatgacttctattgagatctggttgtttgaaggtgtatggcactccccccttcacattctctctctcctgccaccaggtaaagaagattcttgcttcctctttacgcgtccgccatgattgtaagtttcctgaggcttccccagccatgctgaactgtgagtcaattaaacctctttactaattacccaatatcaggcag

SEQ ID NO: 413 - DNA, 661 bp, Homo sapiens
  misc_feature [331]..[331]: Chromosome 2, SNP identification no. = rs2396713
  misc_feature [331]..[331]: allele = c, in linkage disequilibrium with rs10498243, respectively
  misc_feature [331]..[331]: n is a, t, c or g
cctttcttctgtagacacttcctagaagttacacaaaatacttactttttcttatgtcaaattggtcaacatttagtcacatgggtatgcctagtaatatggtttggctctgtgtccccacccaaatctcatgttgaatcataattcccaatgtttggggagggacctggtgggaggtgattggatcgtggtggtggatttcccccttgctgtttttgtgatagtgaatgacttctattgagatctggttgtttgaaggtgtatggcactccccccttcacattctctctctcctgccaccaggtaaagaagattcttgcttcctctttangcgtccgccatgattgtaagtttcctgaggcttccccagccatgctgaactgtgagtcaattaaacctctttactaattacccaatatcaggcagttctttatagcagtgtgagaatggactaatacagaaagttggtgccaggaaagtagggcattgctataaagataccggaaaatgtggaagcaactttagaactaggtaacaggcagagattggaacagtttggagggctcagaagacaggaagatgagggaaagtttggaacttcctagagacttgttgagtggttgtgaccaaaatgctgatagtgatatgggcagtgaaatcc

SEQ ID NO: 414 - DNA, 661 bp, Homo sapiens
  misc_feature [331]..[331]: Chromosome 2, SNP identification no. = rs13004807
  misc_feature [331]..[331]: allele = a, in linkage disequilibrium with rs10498243, respectively
  misc_feature [331]..[331]: n is a, t, c or g
gacaggaagatgagggaaagtttggaacttcctagagacttgttgagtggttgtgaccaaaatgctgatagtgatatgggcagtgaaatccaggctgagtggtctcagatggagatgaagaacttattgggaactggagtaaaggtcattcttgctgtcctttagcaaggagactcgtggcattgtgcccctgctctaaagatctgtggaactttgtacttgagagagatgatttagggcatctggcgcaagaaatttctaagcagcaaagtgtttaagatgtgacctggctatttctaaaagtgtaccctcatatttgtgaagaaggacntggtctgaaattggaacttatatttaaaagggaagcagagcataaaagtttggaaaatttgcagcccgaccatgtggtaggaaaaaaaaaaactctttttctgtggaggaattcaaggctgcagaaatttgcataagtaaagaaatgttaatagccaagacaatgggaaaaatgcctccaggacatttctgagacctttgtggcagccccttgcattgcagtcctggaggcctatgagggaaaaatggtttcgtgggccaggctcagggccatgctactctgtgcagcctcgggacatgatgccctgtatcccagctgcttcagctccag

SEQ ID NO: 415 - DNA, 661 bp, Homo sapiens
  misc_feature [331]..[331]: Chromosome 2, SNP identification no. = rs10048686
  misc_feature [331]..[331]: allele = a, in linkage disequilibrium with rs10498243, respectively
  misc_feature [331]..[331]: n is a, t, c or g
gatctggttgtttgaaggtgtgtggcacttccccctttgctctctctgtcttctgccagcatgtgcagaaggtgcttgcttccccttcgcccttccaccatgagtgtaagtttcctgaggcctcccagccatgcttcatgtacagcctgtggaactgggaatcaattaaacctcttttcttcataaattacccagtctcaagtagttctttatagcagtgtaagaacagacaatacatctagcttacatggagaaaagaaataaattttagctggttagctgtgtcctcagccaaaaattgggattcttaatactaaggaaggaagaatgngtatcaggaggcaaaattatttcaaggatcagtttggtttcaaccaagtaaagtataaagaaagacagtggatgggttatggtcaccacaaacatatactctgtttttcagcatgacatacaaatacagagttaactgttcaggatgccagagaactttagttgtgttatattcacagttttcaaagagaatggcatcaataagaacactgacctggtttaaacatggaaatccactaataactttaagcaagtttgaggcagcagcatgaaatatattctttcacagaagtttatgtgtggcatttctttagagaaagcatccatttct

SEQ ID NO: 416 - DNA, 661 bp, Homo sapiens
  misc_feature [331]..[331]: Chromosome 2, SNP identification no. = rs2894694
  misc_feature [331]..[331]: allele = g, in linkage disequilibrium with rs10498243, respectively
  misc_feature [331]..[331]: n is a, t, c or g
gcaatcccctgatgtttcagtcagcagccatttacaaaccattagaggaaggaatgtgagtccaggtttttgtttgaaaattcctcattgacaccttgttgtaataagatcaagacatttaccaataattagtcccttctttaagccaatgggaaactcgaacttctcctatctttttgagattaggtgaagccatgtgtacttttttcattgtctattcctgtgtaataaatcaccctccaaacctagaggcctattatctcactgtttctgtggatcgagaattcagacaggacacagacatatgggaggtgcctcatctggaagactngaaggctgaggggctgggatcacctggaggcttgatggaggctggaggatccactctgagggacccactcacacacccagtgggttggtactggccaactggttcctctccacataggcttctcttcatctggtgctctcaaagggctgctcgagtgtccttgtgacatgatggctggccttcaccagaatgcaccatctgaaagtgggcccacaccagttgaaggtattctttttgcatttggcctctcgggtcacatatttcaatgtctgccatagtcgtagcgaggcagtaggtctggcccacatgcaagggaaggggaattagtct

SEQ ID NO: 417 - DNA, 661 bp, Homo sapiens
  misc_feature [331]..[331]: Chromosome 2, SNP identification no. = rs11677105
  misc_feature [331]..[331]: allele = c, in linkage disequilibrium with rs10498243, respectively
  misc_feature [331]..[331]: n is a, t, c or g
cagtcaagacccagggcagtcccatcgtgccagacgctccctcagtccctttggcagtcactcctcttttgccgtgccatccctggcaaccaccaatccatgttttgtccctgtagttttgcctccactagaatgtcatataatggacatcatataaatgaaattatgtcattaccggcctgttgagtctggcttttttcagttagcctaatgctcttggagttcatccctgttgccgcatgtatcagtagcttgtcattctttattactgagtaatgttccattatatggatgtgctacaatttacttaccaatttacttgctgatcggngtgtgagttccttccagtttttggccattacaaataaagctgcaatgatcatccatgtacaggtctttgcgtggacctatgtttttatttcagtgcctgggaaggggttgctgggccaaatgataaacattagtgtaattctgtcagaaactaccaaactgttttccgatgtgattgttccattttgcatgcatgagatttccagttgctctgcctccttgtctgctcttagtattgccagtctttctaattttagccatgctaataggtgtgtaacagtatctcatcagggctttcatttgcatttccctgatgactagtgatgttgag

SEQ ID NO: 418 - DNA, 661 bp, Homo sapiens
  misc_feature [331]..[331]: Chromosome 3, SNP identification no. = rs13067187
  misc_feature [331]..[331]: allele = g, in linkage disequilibrium with rs4484159, respectively
  misc_feature [331]..[331]: n is a, t, c or g
ttgagttatttctggctttttatgttttttaaacacttgaaatccccagccagggggacaaaaataagggaacgaataccaaaggcctactatgaaacaagaacctccttgcggcagttgtatgagatagacatctttagctccctctgctgtggacagaactgagggtcagagctgttatgaaactctcacaaagccataccactaatcagtacctgaggttagaatttgaagccatatgtctgtagcgccaaatcccaaaccctctccattctaccgtaaaaatgtatagcatttttactctgaatttacctctattaattacatgccngaaaagaaacaactagactaatagaccatcttttcctttaagtcttcattttttttcagcattatttattgatggcctactgtgtgccaacactggaaatgtgatgcagaatgagataaaaacacaagcttgaagattattccagtggaaagggacaacaaatgtctctaagtgatgaaaccccagaactggccacctggacctcaggctttgtgcccacaccagtacctgagtgtggtgccaacaatctgagttatctttgtttgtagggctgcttcggagagcaatggtctggttaggatgtcgaaaaggcatcactacaagccatgc

SEQ ID NO: 419 - DNA, 661 bp, Homo sapiens
  misc_feature [331]..[331]: Chromosome 3, SNP identification no. = rs6777624
  misc_feature [331]..[331]: allele = g, in linkage disequilibrium with rs4484159, respectively
  misc_feature [331]..[331]: n is a, t, c or g
aacaaggactgggactttcatctattgaataggtactgtggtgctcatttagcaagtatttgtggagcacctaccaagggctaggggagagggagagaaagcaagctgaagagcaagtgtacagagataaagacagaattgctgccctcatagagcttatatatagtgaagttgagagcaaattccctacacattgtttaatcaccactgtgatgaacttacaacagggaagtacaaggtgtcctttgtgttggggaccttagcttgaaggatctgcaaagacttccaggaaagatggaaatttggcataagatgtgaaagggagaaaganagaaaaccagaagagagaaaaagagtaatattccaggagagaaattgtcatgtttaaaccccctagccatgataagtaacaacttggcaagctagttattttcccatttagacatggagaaaatgaggctcaaattgcttataaacctctccaatatcacttagctattaactgtcatgcccactttaaagcatagcctaccctaacagccagttaatcctttagcatggatggtctgtaagtgaaggcaagtcatattacatctctgggcctcagtttccccatttttgtgatgaaggaatttgatagatacttggtaaattgaacctc

SEQ ID NO: 420 - DNA, 661 bp, Homo sapiens
  misc_feature [331]..[331]: Chromosome 3, SNP identification no. = rs9866836
  misc_feature [331]..[331]: allele = t, in linkage disequilibrium with rs4484159, respectively
  misc_feature [331]..[331]: n is a, t, c or g
aggccaggggcattcatggtaatgtgggttgcatgtacatttttattttctggtctgaaatgttattgtgggagcagtgaaaaaaattccgtcaacagagacgaaatgaagtgcaaagtgaagctctttggggaacaaattatttagtttgtatgtttctatagtgatggaaaggagacctgctattcagttttgcacttggccttttttatatagtcaatgtagttgccattctttcaacaagcttgcatctgatttgggttaaggggaagccaatggaaatattcataggtggttcataggagggtggaatccattactatggtttctnttacattatgattgttcaaatgagctggattggtccttgatatattagaattcacaaccaggccaggcacagtgggttacacctgtgatctcagcactttgggaggcctaggtcggcagatcgcttgaggacagaagttcgagaccagcctggccaacatggtgaaacctcatctctactaaaaatacaaaaattatccaggcatggtggtgcatgcctattgtcctgctcgggagactgaggcagaagctactcaggagactgaggcagaagaattgcttgaacctgggaggcggagattgcagtgagccagtatcacaccactgtgct

SEQ ID NO: 421 - DNA, 661 bp, Homo sapiens
  misc_feature [331]..[331]: Chromosome 3, SNP identification no. = rs17015670
  misc_feature [331]..[331]: allele = c, in linkage disequilibrium with rs4484159, respectively
  misc_feature [331]..[331]: n is a, t, c or g
caggcaggaactgtatctgagtctgcctactgttgtatcttcagcgcctagcactctaccaaatgtatccagacccttcattaatatgtgttaaattgttgagaggaagaaaggaaggaaagaaggaagtctatttttatatatatttagggctaaaaaaaacaaatcctcgagttctcacttatcagaccttgtcgtagtaatcagcctgggattggtgttcaaggttccatgtgctaggagtcgtggtacatggccggcacatgcctggcttataataaatacttgaaatatttctagggaagtaaatgaatgtgtctctcttgttccntgcaaatactgtctggaaaatggaagatattcaactttttgtagatggaatgaatagttaatttaagtaagtatctttctaatattactgaaagattccacaaccaaatagaacttcttcctagcagcattaggacctacaggataaaatagccaactgactatagaaggccagtactggaatctttgaaccattctttcccccagacagcagtcctgtctctctttattaatctccattgttctcagtgaatgccctgtttatatctgacagtttatagtttgaagggggaatcatgaaccttacaatcaaagtcctcccggcattttt

SEQ ID NO: 422 - DNA, 661 bp, Homo sapiens
  misc_feature [331]..[331]: Chromosome 3, SNP identification no. = rs4484159
  misc_feature [331]..[331]: allele = g, a
  misc_feature [331]..[331]: n is a, t, c or g
gactcgtaccaccacacacggacgttagggtcgatgagtccctccgattccaccctcttagtgaacttgggtcctcatctccgacgtcactcggttctagtgtggtgacgagaggtcggacccactgtctcactctgggacagagtttttatttttttaatattataaaaaatatggggttatcttcggatcctatagaacagaatttctcacgacggaaggtcttatagtttcagaagttatctagaattttaacgagatacttactggacatcaaagagtcagagataagtgaatcccttattgaatcctctgactgataaaactaggnaaagacgtcaaaaagtttccgtatacgttcttttaatgtgttcggaaactcgaatagtcagatggggtcgtataaaagatcccccacgagtccggttgtccgggtcgccaaaaaaagaggtacggaaagaactggagtaaaagaaagggattaaagggtaagttggggtctttaccacccaaacgttttcggagaaagactagatcctggttttctcggcccgtctgatgtactaaatgtttcggttgtacaaccggatacgggacccatactgtctaaagattatttttccttgtataaataggttcgataacttttcggtccagatta

SEQ ID NO: 423 - DNA, 661 bp, Homo sapiens
  misc_feature [331]..[331]: Chromosome 3, SNP identification no. = rs1604007
  misc_feature [331]..[331]: allele = t, in linkage disequilibrium with rs4484159, respectively
  misc_feature [331]..[331]: n is a, t, c or g
cagataaagtaatacatgtatgggggaggaatagaaacgtgtaattgttgttgtgaatgttatatttgttattgtaggagaaagggagtgtttccagcgttaagataggccctgacctgaggattataaggaaagaaagaaaaaagaagcttctaagtactttcaaagaactgtctaaagatgctttatgcctaaaaaccaaagtagaatccagcctcattgaatcctatgtgcataaaaatagaagagaggagaataagattatttgcaaagatcaagcggtatatctttgaattagtaaaggaaaaagttttattgttaatagagcttngttacctacatgtataaaaataagactacacattcaatttaatcaatatttttaaagatactattattcattaggaacagtgagctattagatgatagatagatcaagaaagttacagttcagaaaagaccatgagacaagcatataaacaaaataatgcaagataagctatcataagtacagagagaaaggggtatgatagaggagagaacatggccaagctaagaatttatgcagatgagaaactacttctatgcttgaagggaggaagcatcttaaatggactgtgaaagaaacaggtacaaaaatggtgagaaatggattctgtgt

SEQ ID NO: 424 - DNA, 661 bp, Homo sapiens
  misc_feature [331]..[331]: Chromosome 3, SNP identification no. = rs988268
  misc_feature [331]..[331]: allele = g, in linkage disequilibrium with rs4484159, respectively
  misc_feature [331]..[331]: n is a, t, c or g
ttttaagtatacggtttgatgccaatataaacttcacgatctaatacctcttgaaggtacaaaaagttttataaacaagtttacattaaatgaaaaagaaagtaatgaatggtccatacccagaatcccgttcaatgaagtagagacgtcatgagacaaaatagacattttattcaccgacctaatctgtcagaaggtttaggacaagttaaaattgtaagatagtgacataaattgtgccgataagttaaaagaatatattaaaactattgataaaattatccctttctacgaacggtccctagggtgttgaattctaaaagataaatgntaaagatcaccttacagtaaaagtggctgttgagtgaaaaaagtctaagatagttacatttgagaaagttctcttttcagtgtccttaagattctacgatggcataaatggttggattctgatgtaaagagtagtctctaatatcgtttgagactaaacccccctgtttcttaggagccgggactaaaacgaacgaaaaaaaatttatcctccaaaacaacgacaaggggaagataatgagcataagagaacattaaacaagtaaacgaaaacatttgtcgtagtggaacttgaaacagaggtgttacgagtataggatcttcgagggta

SEQ ID NO: 425 - DNA, 661 bp, Homo sapiens
  misc_feature [331]..[331]: Chromosome 3, SNP identification no. = rs6550943
  misc_feature [331]..[331]: allele = a, in linkage disequilibrium with rs4484159, respectively
  misc_feature [331]..[331]: n is a, t, c or g
agctgttttatgacgtgatgcaggaaagaaaccagactggagtggatgtagaggagttagcaacatttctacatgccttttatcacattttaatgtttcattaattatttgatgtacagttctgatgtttccattgcttaaaacatggattccttatgtgtattgactatgtgttatctgttatccctagtcctagtaccatacctaccctgtaaaaagtgttcattaaatatttcaatgaataaatcttcctttgcaaacccccttctcctcctatgcttgcaccactattgccttctggtctttccttctttttgcttcctgcactttntaggctgtcaggttatatctgttcttttgcaacatttacgtcacagtttttggctagaaacaaattaactcctattcttctaggaaattaaatcttggccgggtgcagtggctcacgcctgtaatcccagcactttgggaagctgaggcaggtggatcactcgaggtcaggagtttgagaccaggctggccggcatggtaaaactctgtctctactaaaaataaaaaaattagctgcacacagtgccgcacacctgtaatgccagctactcaggcttaggcatgagaaccacttgaacccaggaggtggaggttgcagtgagacgagatt

SEQ ID NO: 426 - DNA, 661 bp, Homo sapiens
  misc_feature [331]..[331]: Chromosome 3, SNP identification no. = rs6777955
  misc_feature [331]..[331]: allele = c, in linkage disequilibrium with rs4484159, respectively
  misc_feature [331]..[331]: n is a, t, c or g
aaaaaaattagctgcacacagtgccgcacacctgtaatgccagctactcaggcttaggcatgagaaccacttgaacccaggaggtggaggttgcagtgagacgagattgcaccatcgcacttcagcctgggcgacagagagagactccatctcaaaaaaaaaaaaaaaaaaaaaaaaaaaaaaaaaaaaaaaaaaatcttaaggattaaagttcaacagtcaaaaaatctgtccccctctcccactctgagtgtacctcccccacccacaacccctttcccctttcatctgcttctctcttcctccttcccttgctcttttctaagagttnaagttccattttgacctatctcagtttgtagaagacacaagttgcagaagttaagaatcactaatcaccatacttctcccatgacaagatatttgaaagatagtttgaggaggaaagaaatagatttagaaggaaactaagaaaacaaaaaggggggtaatattgaggaatagataaattaaataaaaagacttaaattacacattctgtgagtctggtaactactgttctggttaatgacatcaagaaaaaattaacggaagttatgaaatgggttgttagctagtgctttcttctacttgtccatgatgatattttaatccttaggta

SEQ ID NO: 427 - DNA, 661 bp, Homo sapiens
  misc_feature [331]..[331]: Chromosome 3, SNP identification no. = rs6766372
  misc_feature [331]..[331]: allele = t, in linkage disequilibrium with rs4484159, respectively
  misc_feature [331]..[331]: n is a, t, c or g
gtgtatacactgtcacagcgttttatctggcatatgtcaagaacatctgaaagcggagggggaggcagggaaagttagatgaatgagcagtctttttgctgggacagtcgactctgtcttgacccttcagtagcaaatattcacatatacaaatgttgagacacaaaatgaacagtacattatgtggtgtggcctccattaggggagcccatctgacccaattactcatatgaaccacacagtgaggctgaattgtcagtgtagtttcctagggctgtcatgacgaagtgccacaagctgggtggcttaaaacaacagaaatttgttgctngacagttctggaggcttagaagtctggaatcaaggtatcaggcaaggccatgctctctctgaaaccagtggtggagaatccttccttggctcttcctagcttctggttttttggcaggaacctattgggttccttggctttgcaactctattactccaatctctgccttcaccagcgcatggcgttctccctgtgtgtctctgtctttgcatggctcttattataagacatcagtcatattagattagaggcccaccctactccagtgttatctcatctgaactaattacatctgcatcaaccctatttccaaataaggtcatatttaga

SEQ ID NO: 428 - DNA, 661 bp, Homo sapiens
  misc_feature [331]..[331]: Chromosome 3, SNP identification no. = rs994267
  misc_feature [331]..[331]: allele = c, in linkage disequilibrium with rs4484159, respectively
  misc_feature [331]..[331]: n is a, t, c or g
gataatctctatgttaggatgttgtcccaaggatgcacctcagaacattagttctgcaagacagtgaaagcctttcaaaataggttccatggttgtaacagtttgagaaacagtgggttaaacagttagttaggtttctttattgcagggtttctcagaaccttaaatgtgttacttataaggtaaacctctaagagtatgaagcatttctcaaactcatctgacccttggaccccctttctgtggatacttcatcaaagtactttagaaaaccatgtggtaatttactttgcagtaaataatgtgcgtgtaattcctgtaagtgaaaatnctaggggaacagtagatgttgaaaaagaaacaaatatcatggctacaataaggatgcctgtaagtggctttgataagttagaaaccacaatttcaatgtataaagtagaattgggaaacaatagtgacttttttttttttatcaactatcttgtgaattagactttcttattcagagtgtttggattttacagttttaaattgaaagtatgtcaaagtatgagactagagttggtaaatcacgcttttatccatctataaaatagtctatgcctcagtacatgacaaaatcttgacttctgttattcattggacaaatatttctcaagca

SEQ ID NO: 429 - DNA, 661 bp, Homo sapiens
  misc_feature [331]..[331]: Chromosome 3, SNP identification no. = rs1574901
  misc_feature [331]..[331]: allele = g, in linkage disequilibrium with rs4484159, respectively
  misc_feature [331]..[331]: n is a, t, c or g
tctgacccttggaccccctttctgtggatacttcatcaaagtactttagaaaaccatgtggtaatttactttgcagtaaataatgtgcgtgtaattcctgtaagtgaaaatgctaggggaacagtagatgttgaaaaagaaacaaatatcatggctacaataaggatgcctgtaagtggctttgataagttagaaaccacaatttcaatgtataaagtagaattgggaaacaatagtgacttttttttttttatcaactatcttgtgaattagactttcttattcagagtgtttggattttacagttttaaattgaaagtatgtcaaagtntgagactagagttggtaaatcacgcttttatccatctataaaatagtctatgcctcagtacatgacaaaatcttgacttctgttattcattggacaaatatttctcaagcacctactacgtgtcaggcaatgtgccatacactgagttgagtctggattaaattacggatctagctaatgccagttctaaactaaaccagggatcaaattaaagtgtatgttttcaattcataatttatcacaatggaaaactactaacacacaaaggaatagtgtttcctccccataagggtttttctgacattttgaaaaagaatagctttgtccaca

SEQ ID NO: 430 - DNA, 661 bp, Homo sapiens
  misc_feature [331]..[331]: Chromosome 3, SNP identification no. = rs6775433
  misc_feature [331]..[331]: allele = g, in linkage disequilibrium with rs4484159, respectively
  misc_feature [331]..[331]: n is a, t, c or g
tccctctctttattgctcaaatttaaattacatttacaggtaaaaacatcctctatgcttagccatcaggcacagagaatatgtaacacagtctaagatgcagatgtgggggtcttccagtaatttagctagtgccccgacacttgacgtaaaattgcaatacaattagagtgtgtctgcttgcgttttgtcctcgagtttgctaagcttatttttccatgcagatccagctctgcttccctataccccgtctttctcagttaataaaaattgtccttcaatctctgtttatcctttagccaacaaaccagtttcagtggcagcattatgnttacagcccacagaaaccttttctgtgcagtaatttagctgtcagtctggaagtggcaaaagagcagaaagatggatgctgagcctggggcattcctgagccaataccctacatgtccctacttggatgtgcatttattaaagtagatagggaaaatatttcccccgctttctctagccattgctacattatagctagggggaaatatttttactggaactctgctaattgctaagaaccctcttattatccatatacagaggggatgggagggtagagatcatttagtgagagaattgtcctcaggaaaaaaaaaaaaaacctgtaaaa

SEQ ID NO: 431 - DNA, 661 bp, Homo sapiens
  misc_feature [331]..[331]: Chromosome 3, SNP identification no. = rs4858698
  misc_feature [331]..[331]: allele = a, in linkage disequilibrium with rs4484159, respectively
  misc_feature [331]..[331]: n is a, t, c or g
aatattctgagtaagtcttatgattaagctttgtttaaaagcttaattttgttttgtgaaaaacaaattttttgttttgttaaaaagctttgtattttttttgctttttaataaaaccaagtgttttcaaatcctacatgaccacggaagtcttcattcaaatcagaccaattaccacatggaagaacaagagatcctcaatccttcaagaaatgtggggttactttatgaaccacaatgcttcccatgagacatttcccatgacagtgggatttctaggacaaatctggtccaatatgatgggagctataaataaacatcattgtaagtnaggacatcaggtctcttttttgttttcccagtctttcagatttgtgtggaaaaggagcaacttctgttgaagttattttctgtaggcatctaaagtagggcaactatgctttgggcccagatagaaatacattggtcctccccatatggtcaaacccaatattgataattaatgggctcctcaaatagcatgttttcctgttttcctaaactactccttctaaaccaagtgcattggagcattattttttaaatcaaggcataataagcacatagtgaatgtgcagatcttacatatagagtttaagaaattttgacatatgctcacatg

SEQ ID NO: 432 - DNA, 661 bp, Homo sapiens
  misc_feature [331]..[331]: Chromosome 3, SNP identification no. = rs7430038
  misc_feature [331]..[331]: allele = g, in linkage disequilibrium with rs4484159, respectively
  misc_feature [331]..[331]: n is a, t, c or g
ctctcctgtcttttgtgttatttctctaatgtcttttacctttaggtattttatgaaatccagagcacattgttattattcttgctttaagcgatcacttctcttttaataaattaagaagcaaaaaatattgcttatgattacccacatgttcatcttttcttgagctctttatactgaatttccttctgacagtattttacttcaagctgaagaactttctctgctgtttccaataaatattattagaatattaattctaatattgtgcaagtctatatagtgcaagtcttctggtgctgaagtctaaacttttgttactctgaaaacntcttaatatcacctttatttttcaagaataattttgttggatatacagctccagcttggaagctggtttttttaatttcagtaatttagagatgttcttatattgccttcttgcctgtattattgctaataaacacctgttattcttactgttcctctgtatgtaatgtgtttttttccttctggctgcttttagactttttatcttttagcattttaaatattatatcattaggtatgatttttctttttttctgattgggattcattcagatccttgaatttaaatagttaaaatgtattctgatataattttatggaagattactga

SEQ ID NO: 433 - DNA, 661 bp, Homo sapiens
  misc_feature [331]..[331]: Chromosome 3, SNP identification no. = rs1587430
  misc_feature [331]..[331]: allele = a, in linkage disequilibrium with rs4484159, respectively
  misc_feature [331]..[331]: n is a, t, c or g
gtccatcttttatttaaactattgaatatatttacaataacttttgaaatcattgttcactaattctaacgtttctgtcatgtctgggtttctgtattctgttttgtttctcatgattattttttcaagattttgttttccagtaattactgagtgtgtgctaggcatagtaaatgctatgttgttgggactctgggttgtattatcatcctttaaagatgactgcgttttgttctggagttttatttgttttgcaactggactttcaacttggttttaggctttgttgggacaaatctaaagtagctttattttagggttagagttgccntactctttaagatatggcctttataaggtttcaactagatgccctgggtattcagcaatttttatccactccgacaaactgaaatgttgtccagtactgtgtggcttttggaatctttgttcatcttccagcccctcagtagcttttctctggcagagttctctcagtctcatcctctggatatgtatctcagtatttggctaatgactcagtaagacccctaaactgagtccaatgggacttcttccctatttggtaccctattcttcacattctatctaactcagcagttccgtgttccagttgactcctcctcttctcagggaatct

SEQ ID NO: 434 - DNA, 661 bp, Homo sapiens
  misc_feature [331]..[331]: Chromosome 3, SNP identification no. = rs4858700
  misc_feature [331]..[331]: allele = a, in linkage disequilibrium with rs4484159, respectively
  misc_feature [331]..[331]: n is a, t, c or g
aagctgctgtaacaaatagaccaaaatatgtaatgtttaaatgtgaaggaagcttgcttcttgtttatgtaacaacctaaaatggatgatctaggttggaagaagttctcctccacgtaacaatgcagggactcaagctccttacatcttacggctttgccattctctatatccctgattagttaatgtggtcactatgggttcactatatccagatctcttagtgacagataacataatggaggttcagtcaactattaatttcctgggcccagaaatggtccatatcatatccactcatattctggttataggaatggtgaattctaantagccctgaatcatatgcccatccctcatccagttcccaccagaagaacgtgcaatgggccatccataggaaagaacaattttgttaaggaaagcgatagtgggcaaagtaacttcagatgttcaatacatcttacaagatttcccatctttctttgtgtactgtgtcatttgatttgattcttacaatttgctaacgtaagaaggtgattgagggaagtcaggacattttttctcagaaaaattttttaacttatgaagagtttgaattgttgaaggaaagaatcaaactctgtaaaatatttaaagagatttattttgagccaaatat

SEQ ID NO: 435 - DNA, 661 bp, Homo sapiens
  misc_feature [331]..[331]: Chromosome 3, SNP identification no. = rs11294076
  misc_feature [331]..[331]: allele = a, in linkage disequilibrium with rs4484159, respectively
  misc_feature [331]..[331]: n is a, t, c or g
taaagaacagactttataatttatttttggtttattttggttttcctccataaaaattatcctgcaagctgaagatactttattgtatttcagtagcatgcacagaaaaaaaaagtatgtgtttttcaaataatgccaagaccagagtaatatagcacagtaatacaaaattagagtacattggagtatacagaaaattttatatttattatttacacaaagtattttagtgattgagagtgtttttccagcagggataaataaaggaagtacaaataaaaccaaagagagttgaaagcattgatcaggactcaatcatcccaaaaaaaantcccaaattatgaaaagagtatgttgaaatacggtttgatatcagttcactgtatttagtaaattaactgttcttaccattgaaaaagcacttaaagtggtctgaagcaaaatgttgtaattcattttttcatgcgcctattgatagagacttttaaagttatttgttttattttgggttgttttatctcagtgaggttcagcaatagcaagcctctccttgaaagagaagccaagaatatttacaattcatttcctcttatttaaaggagtttgaactgataaatagtttccatacgaatgatactagagtcaagatggaaatagtgct

SEQ ID NO: 436 - DNA, 661 bp, Homo sapiens
  misc_feature [331]..[331]: Chromosome 3, SNP identification no. = rs4858703
  misc_feature [331]..[331]: allele = a, in linkage disequilibrium with rs4484159, respectively
  misc_feature [331]..[331]: n is a, t, c or g
agcggcttctgaactaaactttacactggacagctcgttgctttatgccttctacggaatccaccatctgtttcacatggggtagatataaattttataggcttctcaattaggtttcggtttgtttagggtatttttccccacttactctccaagtgctcatatacataaatgcatgcagctaagtatgactggaatatttgtggagtgggcattaaaaggcatttgtcacattaaaacagttggatacatttaaaagcattctggaaactgaaatgtgaacatctgtataaaaaaagacaaaaaatatctattgttgctgccatccgtnttcatgtaaaaaggtttaatttggggtttatgtttccctctgtggtgctgtgatcatattggtttggtctgcatattctgcaagttatctcaaaattgataaaaatgcatcctgcaacttggttgaatcggaagatgtgtgtggagatatattttcagaatctgagggatggtgtcggggtgtgctgtttcactcaaattaagaaaccagttgcagcacaatgttcttttatggacttgtagtatttggataattgaatggctatgctctgcctcactatagcttaagaggcatctttcctagattggggaaaagcagaaacaagtgctt

SEQ ID NO: 437 - DNA, 661 bp, Homo sapiens
  misc_feature [331]..[331]: Chromosome 3, SNP identification no. = rs2036270
  misc_feature [331]..[331]: allele = t, in linkage disequilibrium with rs4484159, respectively
  misc_feature [331]..[331]: n is a, t, c or g
tagtagaactctatgatcctccactttgtgtgggtgagtcgggtccattttcaccgattcgacgggagaagaggtgggagagaacggaaagaaggagtcgcaaaactaacgtaaaaattgatatacaaggagtgatggactccctttgtcttttgcagtttactacagtctcagttttttcagtcaataacctgtgttttactatgttgatttttatctattgaatgatttaatgtccccctataaaacacatattccgtagaatcttaaccactgattactgatgacagtttattgacctaaaaaccttagacatgttatttaaatctangttgaaggggagagaggtgttaaagaggttaccatagaccagaatgtatttacgaatagaaggaagagaggggagaactccgtggtatgttcaagagtcaaattaatataaggtaattgaggaggggattaagttgtaggaccttagaattaagaaagtgtttgataacagtgttcctggttgttttggattgggttcatcgatgactcacttcaggtcaccctctgtgaactttttatactgtttttggtcggtgcaactcgtttgtacgttgtttcccgtaatccctttaaccaattatatgactcaatgaattttaatattacaact

SEQ ID NO: 438 - DNA, 661 bp, Homo sapiens
  misc_feature [331]..[331]: Chromosome 3, SNP identification no. = rs972016
  misc_feature [331]..[331]: allele = a, in linkage disequilibrium with rs4484159, respectively
  misc_feature [331]..[331]: n is a, t, c or g
gaaatgggttataatgtgtccatccttaacgagagtgagacgtggtgactgaagtagaagaatctcttatttcggtttgtaatctttttattcgtacttattatgtcgtgctatctctagagtttgaagattcaatacacgatgttaaacccattgatcgatactaattccctacgactggtcactctcggttcaccaatacttttagaaagaccttccatccgactttcttaaggacaggatcttatagttgagaggaaaggtgacggacggaaacggacggacatttatggttgaaaagtgggaagtccggagacgaggtcgaagtggnggacacccttcggaggggtgtaaagggtcaggggaacatgtcacgaggggaacgagaaccacttttgagtatcgacacacacatataaaaagacgtacatgtaatataaagtcatttttcattttgtttttaactgtcataaataagtgtaccatgacacctgaccagtaaaagtacagacttagaggtttcctgaaatttgttcaatttccatccctggtaccaaaagagaaacttagaattcagattgggttatgttatgactgtacgtcatgtacgagtcttaagttcaatttcatccccattctaaccctactcgtgtttcgtatg

SEQ ID NO: 439 - DNA, 661 bp, Homo sapiens
  misc_feature [331]..[331]: Chromosome 3, SNP identification no. = rs1603987
  misc_feature [331]..[331]: allele = c, in linkage disequilibrium with rs4484159, respectively
  misc_feature [331]..[331]: n is a, t, c or g
aatagaactgttagatcgggaggggaaagggttccaacgttttttaggatatttacaggagttattcagacacagaggagactttgttcctacctgtcaattgtagcctgaaaccagtccttccgtcttttccattcttcccccggttaaaaggagtccctacagtctgtttgcttgacgatataaatttcggttcccgaaaccctcacggatggacaagacaatggtagaagggaaaatacgagtggtggagtgagtattgatgaattagtaaatggagagtgtctgagggagaacgtgtgtaagagacacgatccatgtgtcggttcgngactccaacgtcgtcccttacctgggttcggggtcgaaagtgtcccaactatgatgtcggtgagttttgtccctacagtactccgacgtcgtagaatttatagaatctccttttgtaagaaattttaaagaaattgttgttcggattattttacttcttgtaaaacgtccccattccccaactacaactcctccttctattatacaatccgtaattgtaacctaaacaagtcttgttaataattattgtttgtgtacgattataaatcctagccccagtcatttgatgaagacatttcctggtctaatatttataaattccgacacaccc

SEQ ID NO: 440 - DNA, 661 bp, Homo sapiens
  misc_feature [331]..[331]: Chromosome 3, SNP identification no. = rs6807196
  misc_feature [331]..[331]: allele = g, in linkage disequilibrium with rs4484159, respectively
  misc_feature [331]..[331]: n is a, t, c or g
gattcccatagccactcggtcacgtgtcaaaagggacaacacacagggttatataccaagatttaagccatctctcacatgtttggtgagatagggaaatgggaagtagaggaacttggatcattacactaaggttgacattcaagtccattcattaatcttagactcctgttggctcttagccctacactcggagctgaggcacaaatcatgcaattgaaatcatggattagaaaggctaaaatagagttaatttaccttgcacaggtaacatttaaggggtagttggaggtgattattggatttatttggtggaacatcacctctgganttccataatatcatttaaagagacttttgttactgacaggtcttgggtctgtcttaagagtcagcagaagccaagattaaccagaaaatgatgaggatttttggttgctagaggcttcatcttatggcacttctagtctcagaaaagatgcttgatgacctatactatacctgagcctgtgagaattccacaaacttactggaaaccaataagaagagcaaaacatgcacgtggaaaagaaaaaaagtaataaacatgtacatcaaaaagtgaaagcctccttctcttgttcccatgctcaacataagcacctatgagtttttgtaaaaa

SEQ ID NO: 441 - DNA, 661 bp, Homo sapiens
  misc_feature [331]..[331]: Chromosome 3, SNP identification no. = rs4858704
  misc_feature [331]..[331]: allele = a, in linkage disequilibrium with rs4484159, respectively
  misc_feature [331]..[331]: n is a, t, c or g
tattttaaaggcaacactgtattattttgtgtagttatatcaacatttatttaactatccttttattgctaaatctttatgttttttttttttattatattcagtatgccctatccttgccatacttcttgattctttccatagatgctttgcagtgggattgctggatcaaaatgtgtttactttttgaaaggctatttgtaattttctttgagtaccaacatacattcccaccaagagtgtatgaggatccctgcttccccatatcctcttccaccctgggtactttaacatttttatatcttggctgctctatttaagcaaaaacttntgtctctttgttttgatttgtaactctttaaaataattcagagtaaagggtgaacactcggaggacatgaagtttgagaatgatgtctgttgtaagcatggtacaggtctccagtccttaaaccaacatttttggatccagatttatgaacaaatttaaaatttttcagattttgaaagatatgtacaggtgccataaattaggtaccactcccaggctagtctgggccagagctccctaagcatgcacgttagcatttctgcagcaaaatgcgtgaatgtccccacaaaatagtctaagatggcagatatccccacatcagttcaggaa

SEQ ID NO: 442 - DNA, 661 bp, Homo sapiens
  misc_feature [331]..[331]: Chromosome 3, SNP identification no. = rs1580817
  misc_feature [331]..[331]: allele = t, in linkage disequilibrium with rs4484159, respectively
  misc_feature [331]..[331]: n is a, t, c or g
aaaaaaaaaaaaaaaaaacgtgtacatatgtgatttgtcgacagtgaagaaaaatatggacaatacttaaaaaattttcacgatagtttcgtgagcaaaatgatagaaaaatgatagaaagaggggacgggaaaaatgtcatccagagtctcttcggacttacgtgtaggatttcgagtaatccatcccctccttttttcaggtcaccacacatctacgagacacccctaagtcctataaacatacaccatatttgactcccctcgttttcatttttgacagactgtgatttttattacattaatacttttataaaatggaaatcgcattnttacaaacttaatcactaaaaagatttagttcttaaaaattttataaaatacgaaaaataatttgataattaagaatatcttttcatgtgtttgacatgcacatgtcgagttacttaaaagtgttcgtgagcactgggagtaagtctaaatctttatcttgtactgcttctttgtcctcgaggggaacgtccgtaatggaggtgagggggttgaagatcgtgacctctaatcaaaacgtatacacacatagatgtgaccatagtttgtcatacatgataatttgtacaccctaagtaagtataacaccgtacatcaatgtgtaacaagta

SEQ ID NO: 443 - DNA, 661 bp, Homo sapiens
  misc_feature [331]..[331]: Chromosome 3, SNP identification no. = rs13060347
  misc_feature [331]..[331]: allele = g, in linkage disequilibrium with rs10510558, respectively
  misc_feature [331]..[331]: n is a, t, c or g
acaaagaactaaaatgtagtaaactattcttcatttgatataattaaacactgctcccagggaaggaaaaaaatatgttattccatgaaacatacatatattgtgtgtttatatataatacacatttaattataaaattatgtttacgtacacatacatacatacatacacagtaatacaaccagcctggtacattaaactgtttaatatttttaaaggctctacatattagactctacatagttcctatattttggagtctgtaattgtgagtcttggcagctgacattttatgggagtgtattaaaatcatttaagatgctacttagancagtaatgctttgacctatgtgaacatcaaaattcataaacaaaatagggtcaggtggagccactagccagatgatgcttccaagaaaatctaaaacttcggaaaataggtggactgcagtgtttgatacaaacttcttctacacattatttcaagtagaaccatgacaaacagtttgaaggaaaaaaaggaacaaacttcttcaggggaaaaggacagaataattttgaatctattgataagcactcttcattactactttcatggaattcttcattgcttgtccaacattcataatccaaaccaaccaagtaatagaggcagagtgtg

SEQ ID NO: 444 - DNA, 661 bp, Homo sapiens
  misc_feature [331]..[331]: Chromosome 3, SNP identification no. = rs17517792
  misc_feature [331]..[331]: allele = g, in linkage disequilibrium with rs10510558, respectively
  misc_feature [331]..[331]: n is a, t, c or g
atattctgttcacaatattctcaatgagggccaattaaagagccaggcaaattggagctcagatcctgttgacatttactgaggcttctgaagaatatgttgtctctaaagaggtacatgaagaatgcagagaattcacactacattaaagcattttgcattggactttatctttgtatgcttttcacttttattatgctcattccaaatcactctcttctatgattatgtggatttttaagaagccagctatgttgtgttacacaattaaagatatcttattgatttttccttttattctatatgatttgacttgttttcacatcaaccngtgctaatggatatatctgctagtatatatccacaggcatttcaattaactcatccaaaactacgttcatcctttctgaagccttttgctccatccgagttccttagcttgctgaagggtaccgttatttgcttggtttataaaaccagaattctggagtcagccttcattgttgactctcctttaatcccatgtccaatctatgtcttattctatctgtgctaccctcattaatgttctttggattcatcatggcggagaccaaagtcttgggccctctcagtgggacccttgcaatagtctcctggctggttgtccagcctcaaagct

SEQ ID NO: 445 - DNA, 661 bp, Homo sapiens
  misc_feature [331]..[331]: Chromosome 3, SNP identification no. = rs17517931
  misc_feature [331]..[331]: allele = t, in linkage disequilibrium with rs10510558, respectively
  misc_feature [331]..[331]: n is a, t, c or g
accagctatcctgaaacaaggaagtgatgatggaaaggaaaattggttgttgttgtaagtaagcagaagataaattcactcctctaccaattttatcttgattattgtaacccatccctggtaagaaaggtaaatctactctttgaagaaactaaatcagaggggttactgagttctagacaccaagcatcaatataccatagggtggtagtggtggactgaaaactggaggaagatgtgaaaggccacatatttcatagtaagtccaccagcagccccagccttattcctccattcgaatactagagtctttcataaggtttttttcttnccaccctaccctgggcagatgcttacaggattgctcaatggagttatccaagagtcccaaataaaaagcccattaatctgacatttggggagtcccacaatgaaataaatgtaacagttatataactttttatgaaattcactcatttgacaaggttcagccatggaaacaatttgcaataaacttcctctttataatatgaatggacagactagagaatttggcagacaatacaaatgagaaatacatctaatgttaatggaaataaaacagaaaaagtaaagagaaagagtctataatatagtaagcagaataaaacactgaaaagga

SEQ ID NO: 446 - DNA, 661 bp, Homo sapiens
  misc_feature [331]..[331]: Chromosome 3, SNP identification no. = rs13068891
  misc_feature [331]..[331]: allele = g, in linkage disequilibrium with rs10510558, respectively
  misc_feature [331]..[331]: n is a, t, c or g
tgtttattttctaattaatttgctacaaactacaaaataaaactattgaatatattggataacgtatgcttttttgaagaaaaagcaccaaaatcatctctgagatgaaaccgattcagaggctgtttactttcttttcatcagagaaacaagttgtagtttgaaagtttgaaaaaggcattgaaattttgggtgggatttttagaattagtgtgttgtataagccaacaggcaatgtcatctcctttgtaagttcagcggagtactagggggcctgggaccatatggtctcactgttgacactgttcgtttttaatattaataggccagngattcaaggccctggggcagatgtcatctaagtgaggacagaagcaaatatcacgactgctcactgagtttttcctctgtagagtacaaccagcataacaggcgttcaaaatatataagcttagcttggcagaggggcaagagcagagaaggtgattcaaattctggcttagcgagggcttactctgtgacattgaggggaattcattgaaactcactgagacctactcttctcatctggaaaataaaaaatatctgccttaaaaagggttagagcttatagtgaggtgcctcacatatggtaaatagtcaatgaaaattatatttgatt

SEQ ID NO: 447 - DNA, 661 bp, Homo sapiens
  LOC442077
  misc_feature [331]..[331]: Chromosome 3, SNP identification no. = rs13061437
  misc_feature [331]..[331]: allele = c, in linkage disequilibrium with rs10510558, respectively
  misc_feature [331]..[331]: n is a, t, c or g
aacacacatacttgggtggaaaagctgaccaacgtggaataaaaagggagcaaacatgttggagaatgactctgtaaagagattcatgtcattgaactgtaggacttactgatatctcttttgtaatctgtacatgtcttgattctgcagctcactagaaagaataaattctcctgcccctgtagtgagggtctgtcagcaccaagtaattgtaaaggctcaataattctctacctcaaaagcaagtaagaacaatttccatagcagctactgaggttatacctgcttgtcactcttctctcattcccttctaactcttgtcagctttatntcctagacctgaacctgagctctgcatattgaacttctctaagcctacagcacaatggctccattcccacacataaagttgtccttgatgctatatctactttgcagtcatttaacctctctgaatttctattctatcaactataaaatatttttacttacagaacagacttttattatatatctaaatcttttaagaatgaagtcgaagtctaaattagaaaggaaacttgtactttaaaggggtgaaatcagatcatacccaagatcttttcagctctaataggcaatgatttcacgtaactcaggtttctcccggtccacatgccat

SEQ ID NO: 448 - DNA, 661 bp, Homo sapiens
  LOC442077
  misc_feature [331]..[331]: Chromosome 3, SNP identification no. = rs17578042
  misc_feature [331]..[331]: allele = c, in linkage disequilibrium with rs10510558, respectively
  misc_feature [331]..[331]: n is a, t, c or g
gtatcatctgatatccatgtactctacccatgactaagtcattctgtattttattaggcttcagctaaattataaatgttgttattattactatctataataattataactaccatttgtgtgagaaactatatacatcatcttgttttttacccacaatagataatatgaggtatttcttgaattcatttacttatacataccatgttttatttggaaaaagaaagattttatgaccacttgtgaaaaaattatatgtgtaactttttaaaattgtaaatgaggacatttggggaaagagaaaataagtacagggaaacaggttgaagcncatttgaggccagtgcattaaaatgcatcctatgatatagataataaatgttgctcaaacaaactaaaagtctaacccaagaagaggagtcacaaagtcatatagttgacagagttcataaaatgaagtcatccaggcatgcagagaagcacaaatgactgtaccatgaaccacatcccaactctacctttataataaatatgattctttatgtgtgtttgtgtttttaatatcatccctcaatgtaggctaaattaatcattccaaaggtcagtcagcaaaagcaggtccctgcaggggtccaaaccctgtctccaggtacatcgctct

SEQ ID NO: 449 - DNA, 661 bp, Homo sapiens
  LOC442077
  misc_feature [331]..[331]: Chromosome 3, SNP identification no. = rs17578259
  misc_feature [331]..[331]: allele = c, in linkage disequilibrium with rs10510558, respectively
  misc_feature [331]..[331]: n is a, t, c or g
tcctccttaggttcacgtttgttttgtaaaaaacaaaaacaactctgtaaacacaaagttattgggaggctgtcagcatgggcatgtattacagactttgatataacttccatgtttctttcatgtattaaaagggcattttagtccatgaaaaaaataggggaaagttttcaaaaccccaagcaaacatatttcttatatagactctgttactcacaatactggcagcaatattgcataaatacttggacattgcttgtgggacaatattattcccttttgaatgaaagctccccttagaatccatctttacttcctctgggcccttaanacatgagttttatatctctaataaagaattttgtttattccaccttataatgtggtcattggtttaaacttttatccctcccatgaaattgtcccgtgctaagagcaagtgccatattatctcctacctcacttagggtgatgcctttgaccagggagattctgagtaactttgttaaatgaaggaaagaatccaaaaatggacagctatgaattttccttccaaagcacatggggaaataagtgaaaagatccatattgagcttttaaatcactttgctggattgtgttacagtaactaagctgggcaataactaagtaacttgcattg

SEQ ID NO: 450 - DNA, 661 bp, Homo sapiens
  LOC442077
  misc_feature [331]..[331]: Chromosome 3, SNP identification no. = rs13100362
  misc_feature [331]..[331]: allele = g, in linkage disequilibrium with rs10510558, respectively
  misc_feature [331]..[331]: n is a, t, c or g
aatactgtatactgaaaatttgctaaaagaatagactttaggtgcttttaccatatgcacatacacaaaaaggtatctatggaaggtgatggatagcataatttgcttgacagtagtaatcaaatagtatatatatacagtagtgtgtatatatatatatacacacacatagtgatatatatatgttgatatatatatatataatgtatatatcatgttgtacaccttaaatacatacaatttaataaaaagattacccggaagtaaaaggctgtcataggagcttaattagagtcccttgagaacaaggtctttttttttttaatttaantctccaattcccaatgcactgaagttttaaataaatgtttattgaccagaagaatgtacgtatttgtataagcattctggaatcaaataaattaacacaatgctgcttttattaatttttaaaaaagactgtggaattttgttaatttctgtgaaccccagtatcaagtttctatgatggccgctctggtctgtgccactttgaacattcagtgacattctcttcttttcctggctctgcttttcaaagcatgcttgaaagagtatggtggaaaaggacactaattcatactaaagagtaaaggatttatatggcttgctttcttatacc

SEQ ID NO: 451 - DNA, 661 bp, Homo sapiens
  LOC442077
  misc_feature [331]..[331]: Chromosome 3, SNP identification no. = rs2068130
  misc_feature [331]..[331]: allele = t, in linkage disequilibrium with rs10510558, respectively
  misc_feature [331]..[331]: n is a, t, c or g
gactcgattttaagtgatagttcaattaaaaagttacgtggaaacaagacattgttcttaaaatttgagtaacttgaaatattccaggattcttttacgaacccttaagtcatttcaacctttcatcaatttccttattctacactacttaagtggaccttatttaagtcttcaacttatataatccctagaggttcgactgcagtgcacgataaaaaattacagacttagcagaattctttataatgaaatcgtacaatgacgactttaattggttggtttaggttacagtagtttatagataagagaatcgggtacttattgatatgcnttgaaagacgtttgacaacagtctttaactcgtacatactgtgatggataagaattcactatgttaaaattcagatccggacccaactactccttaaccatccgagggttctttacctatagaagtccactttgacaaaccttttttttttaaagtattgttctggatgtctctcctacccgttatcaaacatactaccctaaagtcgtcatactatttctggaaaacatggtactttacagaaaacggaagattaatgactgactacagttcgtgtgtgaaaatctctgtgtaaactttgaaaaaacaatttcgaaaacaaagacaatt

SEQ ID NO: 452 - DNA, 661 bp, Homo sapiens
  LOC442077
  misc_feature [331]..[331]: Chromosome 3, SNP identification no. = rs1561115
  misc_feature [331]..[331]: allele = a, in linkage disequilibrium with rs10510558, respectively
  misc_feature [331]..[331]: n is a, t, c or g
gcaagagaagcaggaagtcatttgctatgaccttaccttgctatagggtttgaccatatctagcaaaagtctttcatgtgccctgctccctgtgatccttatgataatcctggggaaagctatagagagttctattcccatttcaaaaaataggaaatcgaggctcagagaggtgactcaaggcctcagagctgtagagccaggactaacactcgactttgcttactccccatccagtggtctttctgctaccccaccctgggcttccatttatctcagagcagtgtgagtttctaccttcacgcttgccttgctctcctggtgagatggntcttggcctttgcacctggatttccagctgatacaggcacttgaagcttatttcattccctttgtcaacccatcatgtgggatccattcattcaactataagtatttatttagcatctactatgtgttaagctctgtgccctcattcatggggaaccaaagacccttaaactgcttatagtcaagtggaagaaaacattttatatataaaatttaatagataatatctgaagtttcctattaaagtcatttttaatgatcctctctcttgaaaggaaattgataaaggaattacctctaggttaaaaaaaaaaatatgtatccatacacc

SEQ ID NO: 453 - DNA, 661 bp, Homo sapiens
  LOC442077
  misc_feature [331]..[331]: Chromosome 3, SNP identification no. = rs17015971
  misc_feature [331]..[331]: allele = t, in linkage disequilibrium with rs10510558, respectively
  misc_feature [331]..[331]: n is a, t, c or g
taaaattccctaagcatcatagcagtcaagggaaaaaggaaaaaacatttttgcaaggttctccccgtctaattgagacaactctctgtccttacgctatgtgctaagttagttcataactgagtgctactaaggtagctttatgtcttacataacacaggtttcataaatcattaccactttttaaagaaaccactgtgtcaggcccagtaccttgcctgaagcctgtaactaataataatcgtggtagtgattattcttagaagtttaataaataatcctcctttgtcatcatgtttttctcgctttcctagactgatacaagtactgncaaaattctgcactagcctaagacattggtgggtataagtctaatccccctaaaagtaatctgtcattatgaagatacaacttgtataatataccgtttctggcagtcttaaagagaagtcacttctcctcttccctctcccatctctttttaaccaaatgctgcttctaggagaacttgattgacacaagctctcaaacccgcatctttcagctgtcaatttagagatctacagtggaaagtgtgtgtttttagcttagaaactaagtggattccagagtgtcttctcatcttgagactgtgcatcctgtttgaacatttccaagtgta

SEQ ID NO: 454 - DNA, 661 bp, Homo sapiens
  LOC442077
  misc_feature [331]..[331]: Chromosome 3, SNP identification no. = rs13096074
  misc_feature [331]..[331]: allele = a, in linkage disequilibrium with rs10510558, respectively
  misc_feature [331]..[331]: n is a, t, c or g
catcgaggggcagatatatgatgactgcaacctaaggcccaggaggcctatataattgagccctatctccttcttactatttaaagttgagctatttttaagctatcaaaaccagtgaccacctgcccctaaactcttctaagtttttctttcttattgctgatgttcttactcgtccaaggatgtttgactttcatttcttcgggtacgtaactgagtcacttggttctttcccaaagatttatattttaagagtcagtttcatagttgtcaaagtgcttgtggatttctatatgattcatagctgatataattctcaaatagattaaanaaacttacacaatgatgccactccaataaatagaagatagaaaaaaagatattaaaaacaaggctaatagagttggtataattgagtattatattcatctctgagaaagcaaaatgaaaaagatgatagatggaaggaatgaacactattctgtttagaaacttcacttctaatattctaattttttatgtagatccttgtataagagatgctaagaacttgatggactttgcctgcaatggtaataatactggaaatacagtaacattcttcatagtgattttttattctcaccttctgacaaagccaaggatcttaaaatattgtctg

SEQ ID NO: 455 - DNA, 661 bp, Homo sapiens
  LOC442077
  misc_feature [331]..[331]: Chromosome 3, SNP identification no. = rs17015978
  misc_feature [331]..[331]: allele = t, in linkage disequilibrium with rs10510558, respectively
  misc_feature [331]..[331]: n is a, t, c or g
gctttatcgaggtgtaatttacaggcagtaaactttaccctgtgtgaataaattttgataaatctagataactatatataatcatgtaactaccacaattaagatattaagcagttccctcatgtcccttctcagtggatcccaccaactggcccccagccctaggcaaccactcagttcctttctgtcactctaatgttaccttttgtagaatgtcatacatatggaattatacttgtagtcttttgacttctttcatatggcatctgtgttgttgtatgtattcatattatgttcgcttttattgctgaacagtatttcattaggattnatttttatgaggaaaaggcttaatgaatattaagtgtagaggctagaagaaatatccatatgaatttgataacaagcataaaggtggcaatttgtattcttgcttgaatagagaacaaatgccttctattccaatatatttttttaatactttacaatgacaagcttgaaagctgagtgatggctggaaccatgctctctagcttcccattatgtctgcaatatctagcccagtacctgcacttactaggtgcttaataaatcattgttaaattagtgaatgaagacattaatagatgttcatcatccatgtacagtagtcatatgaaga

SEQ ID NO: 456 - DNA, 661 bp, Homo sapiens
  LOC442077
  misc_feature [331]..[331]: Chromosome 3, SNP identification no. = rs7432016
  misc_feature [331]..[331]: allele = t, in linkage disequilibrium with rs10510558, respectively
  misc_feature [331]..[331]: n is a, t, c or g
ggagacatgcagggctgggacagcatgtttgccatttaagagatgttctttgatgggctcgtgggctcactgaggaggtaaatatgtttgctgaaacgatattgaaaaatgaaaagcttcaaataaattaataaaagtctgaatatttgagttaggaaatgttttcaaaagaatatgttatataataaaataaatcagtttgacatattaactaagtgtagtagatgtgtttatccattcaaaaggggaatttatttgatgttcattatgaaagcactacagaaatttcatactgttcataagtgttaacaggtctctttttttgctaatngtatcttcccccactctgccaaaattcacaattgagactatattacatatatatttccacaactattttttttatttctcgtaatacagatattctctatattggtacataaaattcctctagaaagtaattgttgacagcttgctgtggaagatgaagaaagtagctacaagttacccacttaatacttctccccattcccatcacaactatattatgtttgctgtattattacattggcattatgaatgtttatggcatttatactcttttattatcataattccaatagtggtttatcattaagtctctgctatatttacatgggaa

SEQ ID NO: 457 - DNA, 661 bp, Homo sapiens
  LOC442077
  misc_feature [331]..[331]: Chromosome 3, SNP identification no. = rs10510558
  misc_feature [331]..[331]: allele = a, g
  misc_feature [331]..[331]: n is a, t, c or g
ttcttttaaaaaccaatagacattgcctctatgtcttttgggagtcaatgtcgctatgtggaagtttgaggccagcctgagttttatatcttgcaggtgatttgacaattttttgtctcaatactctcacatttctatccctgaagttcaaaaacttcaccagaatatatgattctactgattataactattttttatgaataatagctgagccatttggatgtgcagatacagaacttcctttttcattggaaagttttcatctatggtgactttgagggttttttttttttttttttttggttgttcatttgtacagttctctcttttnaggatactctactctttgtttgccatatcttgtattactttcattgatttttagtttccctttgcatttatgttattttctcatgtctgtccttgtcattgcctctctttttagcagtatccattctactcccgtttctaatgtgttttccttttcttcagtaattttatggctttatcttctcggcatgatcagagtgccttttatctctttaattatctcttctcttctattatctcctgtattgattctttgatattcttcacacctactaaagattccatattttcttccatttttttaatcagagaggagtatttgtctgtagtc

SEQ ID NO: 458 - DNA, 661 bp, Homo sapiens
  LOC442077
  misc_feature [331]..[331]: Chromosome 3, SNP identification no. = rs10510559
  misc_feature [331]..[331]: allele = t, in linkage disequilibrium with rs10510558, respectively
  misc_feature [331]..[331]: n is a, t, c or g
gattctactgattataactattttttatgaataatagctgagccatttggatgtgcagatacagaacttcctttttcattggaaagttttcatctatggtgactttgagggttttttttttttttttttttggttgttcatttgtacagttctctcttttaaggatactctactctttgtttgccatatcttgtattactttcattgatttttagtttccctttgcatttatgttattttctcatgtctgtccttgtcattgcctctctttttagcagtatccattctactcccgtttctaatgtgttttccttttcttcagtaattttanggctttatcttctcggcatgatcagagtgccttttatctctttaattatctcttctcttctattatctcctgtattgattctttgatattcttcacacctactaaagattccatattttcttccatttttttaatcagagaggagtatttgtctgtagtcctttttatttcccattccctgaaatttactgattgccttaactttttttggtgggagaccaggaaatgccatggtaaccatgtgcaggtggcatatttgatccttgctaagttctctatgtgtgactttttgtgtgctaaccctagtttaagcattaataaaagcacaca

SEQ ID NO: 459 - DNA, 661 bp, Homo sapiens
  LOC442077
  misc_feature [331]..[331]: Chromosome 3, SNP identification no. = rs10510560
  misc_feature [331]..[331]: allele = g, in linkage disequilibrium with rs10510558, respectively
  misc_feature [331]..[331]: n is a, t, c or g
actttttgtgtgctaaccctagtttaagcattaataaaagcacacatgcaggaagtaagttgagagtagcatggatagtctctcaccagtgtaccttctgctctagatgaatgtttctctcctagaagagcaaatctttgaagtagtccttggagtgactcctagtgaagattcttcaccaagttgcaatttgtttctcttttttccttgtttctttgtttcgcctcctctacaatatgctctccttgttgcaggagccagaactctacaaggatgtttttgtctctgctgtcctatccactaactcagtcttcactcttctaagggatcnactattgtctgagtctttcaagacctgctaacttaccttcagaaagatctatatcctgccagataaatctgcgatgatttattgccagttgtttttacaccccaacttggagcaaatgttgctgtttcaggcaaaccatctttttagtccattatttgtagttgtcattgtttcttagtttgattataggttatattttctattctattttttattccttttattcacttctacgcattttaagaaagataatatacataactttattatcttttaccatatgaatttctttctgaaggtattcaaaaaaacaaatatttctaaattgaa

SEQ ID NO: 460 - DNA, 661 bp, Homo sapiens
  LOC442077
  misc_feature [331]..[331]: Chromosome 3, SNP identification no. = rs13092896
  misc_feature [331]..[331]: allele = a, in linkage disequilibrium with rs10510558, respectively
  misc_feature [331]..[331]: n is a, t, c or g
agcatgaaacccatataagctataggggtgttgttgttgttgttgtaggtgccctttatttgggtaagagaatttattattactggtttgccaggcgtttttgtttggttgttgtttttttttttttaatcatgaatggatgttgaattttgtctaatagtttttctatatctattgagaagatcatatggttcatcttccttaatctgttaatgccatcattaacttcattgatttttgaatgttgagctatccttgtgtccccagaataaactcccaattttctgatatattattctttttacattcaatttactaatattttgttggngattttgaaggctattcatgacaaatagtggtctgcagctctcttgtaatatctttgtcttgttttgctttagggtaatgttggcgtcattaacagaattgagaaatattactttctccttaattttctgaatgagattatgtggaattgctattaattctttcttaaatattttctagaatttaccagggaaacaatctaggtttggagttttctttgttgaaggtttttaactatgtattcaatttatttaatatatgtagactatccaagttacacatttcttcttgagtgacttttgttagtctgtatctttaaaggaattggtcc

SEQ ID NO: 461 - DNA, 661 bp, Homo sapiens
  LOC442077
  misc_feature [331]..[331]: Chromosome 3, SNP identification no. = rs7427426
  misc_feature [331]..[331]: allele = c, in linkage disequilibrium with rs10510558, respectively
  misc_feature [331]..[331]: n is a, t, c or g
tggaaatgcagaaatcacccgccttctgcgttggcctggctgggagctgcagatgggagctgttcctatttggccatcttgcccgggaatcattttatgtcttaacatatctattctgaagaatgttccaagtactgattagagggaatgtgtatactgtagctgttgggtgaaatgttctgtaaattaatgttagatccattagtctaaagtgcagtttaaatctagtatttctttgttagttttctgtctagatgatctgcttaatgctgagagtggagtgttgaagtccccaactattattgtattggaattcctcttcctttaaatntaatatttgttttatgtatctggatgctctggtgtcggatgaatatatggttcaggatttttatttcctcttgctggactgatccttttatcatgatataatgactttttgtgtctctttgaactgtttttgattttaatgtctgttttatgaagtatagctactcctgctcatttgtggttttcatattcatccaatatcttttttcatccctttactttcaatctatatgtctttaaggtgaggtgagtttcttgtaagcagcatataggtggatcatgtttttaaaattcatttagccactctatcctttaagtgaaaagtttaatc

SEQ ID NO: 462 - DNA, 661 bp, Homo sapiens
  LOC442077
  misc_feature [331]..[331]: Chromosome 3, SNP identification no. = rs1601161
  misc_feature [331]..[331]: allele = a, in linkage disequilibrium with rs10510558, respectively
  misc_feature [331]..[331]: n is a, t, c or g
agctactcctgctcatttgtggttttcatattcatccaatatcttttttcatccctttactttcaatctatatgtctttaaggtgaggtgagtttcttgtaagcagcatataggtggatcatgtttttaaaattcatttagccactctatcctttaagtgaaaagtttaatctgtttacattcaagattattattgatatgggagggcttactcctattattttattaattgagctattgttattttgaatattctttgtttctttctctcctgtttatcattgtgttttgttttctgtagttgtaaccattggaccctttcctttccttntggtgtgtttgctctaccagtgttttttatacttttgtgagttttcatgatggtagatagtatctttttgtttccaggtgtaggactcccttaaagcattttttacaggacaatactagtggtgatgaattccttcagcttttgcttgtttgagaaatactttatttgtcctccttttataaaggataattttgctggatccttggctggcaattttttctttcagtatttaaaatgtatcattctgttatctcctggcttgtaagatgtctactgcttatatgtctactgttagtctggttggggttcccttataagtcattagattct

SEQ ID NO: 463 - DNA, 661 bp, Homo sapiens
  LOC442077
  misc_feature [331]..[331]: Chromosome 3, SNP identification no. = rs1992060
  misc_feature [331]..[331]: allele = a, in linkage disequilibrium with rs10510558, respectively
  misc_feature [331]..[331]: n is a, t, c or g
cttatcattttaaaagaacaactacgaccaatacattttgataagaaaattctatccgttttatgcctacatgttgagtcgggaggaaaggaagtccaaaactatctcttatcttatttttttgtgtacacatagtttcacagtcgaaacaatcgttaatgttcatggataaaaggtgggtttaggtcttgagaaaccatcatgatcatcaactgtcctgatctttcgtctaatttttaatccgtttaccctattaatttggaagatagtagatggagggtgtacattagttctaaacacttaggatcacggatacttctgtcaagtcganttgaatgtatgaatcagtgtctgtgtatttaaccatgtctctccctctctcacgtataatgggaggggaagtatctctgagacgagtcaacccgagttgtttaccctggatcttcgacttctcttccctttcattttcggtgccacggtctattttcttctaggtattcagtactgagtgtgaaacacacaacccgaaagtagttaatctgacctacgatgacaagaggacctcttctcaattttcccctatatctatttaaacttcgtcaggaaggtgtttttttaaataatcttcattatttatacaagtcgttccaccgtcttatgt

SEQ ID NO: 464 - DNA, 661 bp, Homo sapiens
  LOC442077
  misc_feature [331]..[331]: Chromosome 3, SNP identification no. = rs1992059
  misc_feature [331]..[331]: allele = a, in linkage disequilibrium with rs10510558, respectively
  misc_feature [331]..[331]: n is a, t, c or g
aactactacaagttactcttctgcgactctgtcttgaggtatttgataggaagtgctggagattttttatacgacacggtggagaatagaagtgtaagaacctataagaataaaaaaaaaaggtatgaaattgtagaaagtagtaatatgtgcaaacggtttcttgagatatacatcggtttaaccaaagaactcaaaggaaatagaaaagacgaggtgactaatgcatcttaaagtaaatactgtgggaaggtaggaaatactgttctgacaggaaactcaaaaccagtatgtaaagatgaatataaacgagtttatttttaagacttgngtaccaatatgcaaactaatacccgatgaaacgtcgtgtcccaaaacaaaagtattcttaaaaattttgttgtacctgtaggaaatttcctagagagagaagttagttaaagaagaataaataaattgatgaagaattacgaatatatacaaagggaataacgaagagaacgtaagatcctgtaatacagttgttctcactttcttatttccatttatctaaaagatctaactccctcgttatactctttttcctctattcatttccattgtcacacaagaagtctaagaagtgtatacatacaaattaaggaaagagactacctctaat

SEQ ID NO: 465 - DNA, 661 bp, Homo sapiens
  LOC442077
  misc_feature [331]..[331]: Chromosome 3, SNP identification no. = rs13082318
  misc_feature [331]..[331]: allele = c, in linkage disequilibrium with rs10510558, respectively
  misc_feature [331]..[331]: n is a, t, c or g
cagaatttttatttgagcaaatataagtagaaatgtatgaccaaaactcaaaggacagtcttgtcataaaggatggaagggtgtcataaatgaaattctacgtaatcagtggagcagaaaagataaaggaaactcaagaaaccaatttggctacatatagagttctttggcaaacgtgtataatgatgaaagatgttaaagtatggaaaaaaaaaataagaatatccaagaatgtgaagataagaggtggcacagcatattttttagaggtcgtgaaggatagtttatggagttctgtctcagcgtcttctcattgaacatcatcaagaanttggaagagaacattagctttgtgcttgacatgcttgcccaaaatatcatacgataaggactatcctaaaagctcctgacagcctcagaaaagggttagattttaccaagggaaatgtaagctcatcaatgtagagttatgcacacatttaaagaacatctgcccctgaatgaaatagggaatgaacttaccagcaacacatatgatggttgacagtaagttcagcatgactcagtaatgtggtatgtctgcttggtgacttaatttgatgcttgaatgcagatcaaagattgtgctgatgaaccacacttggaggagtgtgctccattc

SEQ ID NO: 466 - DNA, 661 bp, Homo sapiens
  LOC442077
  misc_feature [331]..[331]: Chromosome 3, SNP identification no. = rs13087573
  misc_feature [331]..[331]: allele = a, in linkage disequilibrium with rs10510558, respectively
  misc_feature [331]..[331]: n is a, t, c or g
ttccgggtaccacatcttaaggggcatgttggccaactggactgtgtccagcacagaggagtgagagtagaatgaaaagggaattgcaaacagccttgcagaaaaacacgtatgaacagggcatttagcctagagaagaggagatactcatagagatgtaataattgtcttcagattctggaagggctgatctctggaaaagtgattatgattgatctctgtgtctaggagaagaaaaccaggacagaagagttggaactagggtggggcaggttttggatgaataatgagatataacatctaaaatagtccagatatggagtcagtttcntcaggagatctgtcttgttaatgatgtttaaatggaaagccctgtgtccaagttcgtccaagtcctgcggtctacctgatgcctccgctccttcctaggctctatctgctctctatttacagagtcttccaagacctcccttttccactcaacttctcttcatctattttattccccttctatctcttccaggctccttatttcttcccaaaccttctaagccctctttgttacctagtcctttaaaacaccccaaataccatccgacattctcagcctgaaaaactcaacctttctcatcaaagcacaaatcatgtgtctactcatgaa

SEQ ID NO: 467 - DNA, 661 bp, Homo sapiens
  LOC442077
  misc_feature [331]..[331]: Chromosome 3, SNP identification no. = rs17016060
  misc_feature [331]..[331]: allele = g, in linkage disequilibrium with rs10510558, respectively
  misc_feature [331]..[331]: n is a, t, c or g
tctaaagatgatttccatatggggagctccaaaaacatttaaaggaatggtaaacttattacacaagtagctaatcaccccaaagtgatgattttgaatggtcagcactcttctgtgatagttgtatgttgttttatggtcgcaattgatattgtaaagtaggcagaatgcaggattcctcagggaaatgttaatcagaatagaagctgctgggaggtttgcttgatgaaatgattctgataacatgatctagcaagggtaaagaattagtcaacaccttgaaattctgactgtttgtggtcctcagcccaggggagtaccaaccctgaantgggcatttggaatgtatagtggttttggttgtcatggtgtcttggtctgttttctgttgctgtaataaaatacttaagactgaataatttataaaggaaagaggttgatttagttcatggttctggaggctgggaagtctaagatgagcagctgcatctcctggcttctggagagggctttatgctacctcataacacaggagaagcagaaggttaagcagcaggcacctgcaaaagacaccaaacaggagcggcagcctcactttaacacaactctctcttgcaataattaattcagtcttaatagaggtccctgaatgtattctcaa

SEQ ID NO: 468 - DNA, 661 bp, Homo sapiens
  LOC442077
  misc_feature [331]..[331]: Chromosome 3, SNP identification no. = rs13074533
  misc_feature [331]..[331]: allele = a, in linkage disequilibrium with rs10510558, respectively
  misc_feature [331]..[331]: n is a, t, c or g
tagtgctcagatgagagatgtcatctgcagccgcctgtgttcagttgaagattaactttgctaatctcaatattcataccacttaattcagcctgatgtcacccattcagcctgtcactggggctgggtgaccttaggcaagttgattaactttgctgattcttgttttatctgtttaattagtatggtggcagaacgtactcattggctcacgtatggagaaaattaaataaaataggacatgagacagcaaagcttagtagttaggaaaatagcctctggagaatgttggccctaatactcactgagtaattttggacaagtcacttancctatgtttctatttctttatctgtaaaatgaggctaagagtagtatctacctcctagggttgttgtgggaattaaatgagttaaacctttaaaaacactgggtttctggtagggagtacatgttctacatgtgttacttaaataaattgtaatatttagcacataatgaatactcaagaagtgctagttgctattgtcatcattattgtagttagatgatggtcatcatgatcaccaccataattgtcatcacatcatctaattattctctttctggaccctgctacatttgaccctatttatccttcccttcttcttgaaactctcta

SEQ ID NO: 469 - DNA, 661 bp, Homo sapiens
  LOC442077
  misc_feature [331]..[331]: Chromosome 3, SNP identification no. = rs10510561
  misc_feature [331]..[331]: allele = a, in linkage disequilibrium with rs10510558, respectively
  misc_feature [331]..[331]: n is a, t, c or g
ttccacgttcatggtccccttccttcatcttcaagtccagcaatggctggttgactccttctcacactatatcaatctgatctattgttctgctttcctctttcacttttgaagacgcttgtgtttaccttgtgcccacctgggaaatccaggagaatcttcctatcttaaggtcagccggttagcaagcttaattcctatatcctataatgaagcatgtttatagtttttaggaggtaggacttggacatctttggagaggatgtcattctgcctgtcacaatatctctcagtgttcctataacattctgtgcttacctctatcattccncattagtaaatattgtcataagcatttgtatgttctctctctgacttaattttgactgtcttaaggtctttctcatttttgaatccctgccttaagagtaaatagtagactttctataatataggtaattcaaatgtctagtgataacctgggacccctctagggatcagcacagaagggggattaacctgtgcccagtaatttgagttatgcatgttaatgattccatttctatgaacgtttgtcatccaatgtgatggtagtcatgtaagttgcactggtctgcttgctctagccgataataaaattatatattgtaataaaattaca

SEQ ID NO: 470 - DNA, 661 bp, Homo sapiens
  LOC442077
  misc_feature [331]..[331]: Chromosome 3, SNP identification no. = rs17016078
  misc_feature [331]..[331]: allele = t, in linkage disequilibrium with rs10510558, respectively
  misc_feature [331]..[331]: n is a, t, c or g
ccgataataaaattatatattgtaataaaattacatattgtatatcacttatcagacctttttcttggtaccttcatgtgttaattcatttagtctttacaacagtcttctgctgtaagaacaattagtattgcccattttatgaatatggaaactgtggcatcgggcattaaataacttgcctagtgtcagacagcttagtatacagtaactctgagttaactagtctattttgccaacccaaacaatcccttctgtgaccagtctacttaaatgagaggccactatagttaatttgaaatgttgtttatttctcatgaaactcaatagnctttagcctcatgggtttaagaagagaactgagtgaattagctgactccatctgagatttttcagccagccaacctctaacacacacaggctatgggcctcaagtgtaaaaaatgagccatgtattgtctttcaaagccaccttggtctttgggaaaatccttggtcctaaccatgagtccatggatgatcattttgtcagtttgatgagagtcagtgctaggggaaggccagtgtgccagggaggaaagatggagggacgaagcacattaaatctgcagttgcttacagcatctgcctttgatgctgtctctgggggacacactgatcg

SEQ ID NO: 471 - DNA, 661 bp, Homo sapiens
  LOC442077
  misc_feature [331]..[331]: Chromosome 3, SNP identification no. = rs13093059
  misc_feature [331]..[331]: allele = c, in linkage disequilibrium with rs10510558, respectively
  misc_feature [331]..[331]: n is a, t, c or g
gccagtgtgccagggaggaaagatggagggacgaagcacattaaatctgcagttgcttacagcatctgcctttgatgctgtctctgggggacacactgatcgcctcctcccagtcaacaaattctgtgtcttctcagcagttctgaagggggagagccctttaaggcattttgtactgacaagcgtatttctcttagagctctagaatgtaatagaagccatcaaaggcaagggatatcaggaggttgttttgcacaatggcaacagaattcatacgttttcagacgactcccatgctcatatcagcagttcaattagtggcagggtaaantaataatatatatttcccacttggggcattgttgatttttttttttaaaaaaaggttgattctgttttatcacaaacaactttgtttagaaagccaatgatatttttcactgaattcaaagctcttgctaaactgtaacctgaatggtttgtaatctaaggaggagaggaagaaagtgtgaacaacgttaaatggataccgtcatcccagtatgccttcaagaaccctggggtgaaaagggaaactggtttttctccacttaatagacatgatgggcaagatctactatttttttttatataaggcaaaggctaagacccagtctccagc

SEQ ID NO: 472 - DNA, 661 bp, Homo sapiens
  LOC442077
  misc_feature [331]..[331]: Chromosome 3, SNP identification no. = rs13068143
  misc_feature [331]..[331]: allele = c, in linkage disequilibrium with rs10510558, respectively
  misc_feature [331]..[331]: n is a, t, c or g
actgaattggaaatacggactttaagaaggtgattaaggttgagtgaggtcataaggctggagacttatctgatagaactggtgtccttttaaaagagacagagacaccagaacttgctttctctccctgccatataaggaaacagtgagcaggcagccctctgcaagccaggagaagagcctcaccagaatctgaccatgctggtctccgattgcagaattctagcctcctgaaaaatgagaaatacatttctattgtttaagcccccaggctatgctatcttgatgtggcagcccaagcagactaacacaatcaccaacttggaaatantgagcaaccacaaagctgcctgtagttcaattttccccctttctaaatgctctgtgattctgaccccttccctgaagctctttaggcataaatatgtaagaaaacttcccacaagtgatctgatacaacagaggccttagctagctacagcagattgtaccgagtgttctacagggagatattctgaagacagaagactaagtggactttgcttctgtgtttactaagcaccttcattttaaccagactttatttagagagtatatcattttgagcagctagtatacaaggcattgtaaggaaatggtgggaacacagcagacaatggaa

SEQ ID NO: 473 - DNA, 661 bp, Homo sapiens
  LOC442077
  misc_feature [331]..[331]: Chromosome 3, SNP identification no. = rs13091754
  misc_feature [331]..[331]: allele = t, in linkage disequilibrium with rs10510558, respectively
  misc_feature [331]..[331]: n is a, t, c or g
agcagattgtaccgagtgttctacagggagatattctgaagacagaagactaagtggactttgcttctgtgtttactaagcaccttcattttaaccagactttatttagagagtatatcattttgagcagctagtatacaaggcattgtaaggaaatggtgggaacacagcagacaatggaaagcctttaaatgttaaagcagtgaaggcctctcttagaggccaaataatgcccccagctccactctggccttccgcaacccccgtctttcacctcacattaccgctgcctattccttatccagatgtcctgaagtctctattttttagncttttctgagtttaaattgttttcctaactctaccacttacttctttgatctgtctttatcacctcttgttcagtgtcctcttgtttttagaataactttctggcttgagagtggtgtttggatgctggaatcctacagaaccttctcttccccatgcttgagtgaggttatttttattctgtagcaaatgtgccaagtatttttagtgtttggatattattctgaaatagtcatttaagttactcaaatttgggagctatctggaagttcattttatgtgactggagggctataatttatggttactccagtatttggttaaatataca

SEQ ID NO: 474 - DNA, 661 bp, Homo sapiens
  LOC442077
  misc_feature [331]..[331]: Chromosome 3, SNP identification no. = rs17016117
  misc_feature [331]..[331]: allele = g, in linkage disequilibrium with rs10510558, respectively
  misc_feature [331]..[331]: n is a, t, c or g
taggaggagagttatatatttcttaagtcatcagtggttatagtgtcaaatttcttggaacgtagaatagtagagatttgtaaataaaattttataatcttcccaaacaaaaaaagtgcttgaggtcacagtctaacatgaacgacatcaaccttcctcttttaatcttttaacagctctcagcggtagatttctccatctccattagagagcatttggtgactaccactgatactttttttctttttttaggaccaggtagatccaccattgaagggctggttcattatttgatgtagaagaaatgaatgttaatgttggacctattcangtgtggctaaatgcacatctgtaatctattttgtgttcatggcacttctgattcacagtcccccagaaaatagaaaaaaaaaaaaagtcaagatgccatgtggcctacaaaagtggatctgtgtttttcatattattttctccaactcagattttagatatggtgtatttcgaccctggtcctcaccagagtttagcatttgatacattccattgttatcatggagaattcaaggaatggaagaatttattaatgttagcccctcttttactctgttccactcactctgccttccttgttgtacaaacattcctgggaggctcctgcctc

SEQ ID NO: 475 - DNA, 661 bp, Homo sapiens
  LOC442077
  misc_feature [331]..[331]: Chromosome 3, SNP identification no. = rs17016120
  misc_feature [331]..[331]: allele = g, in linkage disequilibrium with rs10510558, respectively
  misc_feature [331]..[331]: n is a, t, c or g
caggtagatccaccattgaagggctggttcattatttgatgtagaagaaatgaatgttaatgttggacctattcaggtgtggctaaatgcacatctgtaatctattttgtgttcatggcacttctgattcacagtcccccagaaaatagaaaaaaaaaaaaagtcaagatgccatgtggcctacaaaagtggatctgtgtttttcatattattttctccaactcagattttagatatggtgtatttcgaccctggtcctcaccagagtttagcatttgatacattccattgttatcatggagaattcaaggaatggaagaatttattaatnttagcccctcttttactctgttccactcactctgccttccttgttgtacaaacattcctgggaggctcctgcctcagcacctttgcactggttgttcccttagtctgagatccacttttacccattgttcactttctcatttcattttggtttctctcaaacattgtctcattatagaaaccttgcctgacaactctaacatgtcagcctctctgcgcttcttaggacctttctctcctcttacctgctttttcttcttccccactatgatttggtatcaaaatatttgtgcattttgcaattcagtgtttacagcctgtcaaaccaccc

SEQ ID NO: 476 - DNA, 661 bp, Homo sapiens
  LOC442077
  misc_feature [331]..[331]: Chromosome 3, SNP identification no. = rs13059799
  misc_feature [331]..[331]: allele = c, in linkage disequilibrium with rs10510558, respectively
  misc_feature [331]..[331]: n is a, t, c or g
gtatgtacaacagaatattattttgctttaaaaaggaatgaaattcagcgacatactacaatatggttgaaccttaaggacattaagtgaaattaagccagacacaaaaagacaaatagtatgtaattccacttatatgaggtacctaaagtagtcaaattcatagagatctgtacacctaaaaattgttaaaatggtaaaaatgttatgcatattttaccacaataaaaaagatatatttttaaaacctgtcacattcgaagcaaatggaatgtgtacatgtttgtttaaattccctgtagacctaaaaaagaaggtttatatgcaaaanttaatggggagagaataagccgtgttatcccagcctatcactgataattaatacctgggtaatattatttgtttacaaagcacacatatcaccttatgatgttctcacggtatcccttgaagtagtgctatttttatccctctagtgcagatgaggaaaatggatctcagaaaaattaagtggtgtggtgtttaaggttgtaacaggttggtgcaaaggtaattgcggtttttgccattaaaagcaatgggcattacaagcaatggcaaaaaccgcaaatactttcgccccaatctaatattactggtaagttttgtgtcggggcttaag

SEQ ID NO: 477 - DNA, 661 bp, Homo sapiens
  LOC442077
  misc_feature [331]..[331]: Chromosome 3, SNP identification no. = rs13082440
  misc_feature [331]..[331]: allele = t, in linkage disequilibrium with rs10510558, respectively
  misc_feature [331]..[331]: n is a, t, c or g
tggttgaaccttaaggacattaagtgaaattaagccagacacaaaaagacaaatagtatgtaattccacttatatgaggtacctaaagtagtcaaattcatagagatctgtacacctaaaaattgttaaaatggtaaaaatgttatgcatattttaccacaataaaaaagatatatttttaaaacctgtcacattcgaagcaaatggaatgtgtacatgtttgtttaaattccctgtagacctaaaaaagaaggtttatatgcaaaacttaatggggagagaataagccgtgttatcccagcctatcactgataattaatacctgggtaanattatttgtttacaaagcacacatatcaccttatgatgttctcacggtatcccttgaagtagtgctatttttatccctctagtgcagatgaggaaaatggatctcagaaaaattaagtggtgtggtgtttaaggttgtaacaggttggtgcaaaggtaattgcggtttttgccattaaaagcaatgggcattacaagcaatggcaaaaaccgcaaatactttcgccccaatctaatattactggtaagttttgtgtcggggcttaagcccccagtcttcaggcatttattcctgtgttctctccttgaaatcataccatcccttgaccag

SEQ ID NO: 478 - DNA, 661 bp, Homo sapiens
  LOC442077
  misc_feature [331]..[331]: Chromosome 3, SNP identification no. = rs17016133
  misc_feature [331]..[331]: allele = t, in linkage disequilibrium with rs10510558, respectively
  misc_feature [331]..[331]: n is a, t, c or g
ccatataggataagcataccaatgtctcaagaatcgcgtctcaaatgcaaggcctacacaagagtatttgtttcttgagctgaaagaagtgaccagaaaatttagtcacgttccttggccaaaggcatctacattaggaaaattaggtgctttctgcgtttctgggagaatgagttgatattggcatacaactaactttcttttggaagagtttccatggaaaggtggtcattagatgaaatggtagttccgtctttcctgcaacataactcttgggagcatctgagaggaaggttaggagatacttgctattcccaaaactcattctcancagaaactttaatattccaaggtaagaattttcttattcagtaatcttgtttataaaagaaaaccaaatacactaaagcactttaaaaaaatcaatgctatctgtacctttattgtcaaaaaccattttctagtaaggcttttttaaaatgttcaatcttgctgaataagctaaaggcatgtatagagtaagtaggcaacagcatagtttaaaattaaaatacttatctttgtcctttacaaattctttgtctcctgcctggttgggagagttctgagaacttccttgcattgtgtgatacagcggtcagtaatcacatgtggttattta

SEQ ID NO: 479 - DNA, 661 bp, Homo sapiens
  LOC442077
  misc_feature [331]..[331]: Chromosome 3, SNP identification no. = rs13084418
  misc_feature [331]..[331]: allele = g, in linkage disequilibrium with rs10510558, respectively
  misc_feature [331]..[331]: n is a, t, c or g
tcgggactgctgagtaaaaagatgggaaaactagtacaaatttctggagcctggctccctggaaaggggacctaagacacatctcatgtgtatttgctgtaataatgctgtgaaacaacccccaaatctcattagtttataataacaactattttttttgtaggtcagcctggctctgcagggctttggagggcttagtgggaatcagctggacttgactttcttccgcatgtccccttattctgggaccagcagctgcctctttatatagtcttttcattatagcggcaaaaatacaggaaggggagaggaaatacataaggcatcttanggctcagggtcgggactggcagactgacatttctacccatgttcctttggccaaaggaagtcacatcaccaagctcaacagcaatggggtagggaaatatccttgcccacagtggagggaaggaaatggtgtgagccagtaatcaactgtttatgctatgtaaggatacttagctgatcagcatttgcttggaagctcaaaaatactgttttttaaaaaagatcttcgtcttctcttggccccatgctcttatgtgctgccccatcatgctatcagaggtcactgcacagtctcagtcatagtggtgaccacatcatacccacagactct

SEQ ID NO: 480 - DNA, 661 bp, Homo sapiens
  LOC442077
  misc_feature [331]..[331]: Chromosome 3, SNP identification no. = rs13084608
  misc_feature [331]..[331]: allele = g, in linkage disequilibrium with rs10510558, respectively
  misc_feature [331]..[331]: n is a, t, c or g
tttgctgtaataatgctgtgaaacaacccccaaatctcattagtttataataacaactattttttttgtaggtcagcctggctctgcagggctttggagggcttagtgggaatcagctggacttgactttcttccgcatgtccccttattctgggaccagcagctgcctctttatatagtcttttcattatagcggcaaaaatacaggaaggggagaggaaatacataaggcatcttagggctcagggtcgggactggcagactgacatttctacccatgttcctttggccaaaggaagtcacatcaccaagctcaacagcaatggggtanggaaatatccttgcccacagtggagggaaggaaatggtgtgagccagtaatcaactgtttatgctatgtaaggatacttagctgatcagcatttgcttggaagctcaaaaatactgttttttaaaaaagatcttcgtcttctcttggccccatgctcttatgtgctgccccatcatgctatcagaggtcactgcacagtctcagtcatagtggtgaccacatcatacccacagactctccgtgagcacctcttaacccaagtctggctaggcgcggtggctcacgcctttaatcccaacactttgggaggtcaaggcagaaggattgctt

SEQ ID NO: 481 - DNA, 661 bp, Homo sapiens
  LOC442077
  misc_feature [331]..[331]: Chromosome 3, SNP identification no. = rs17016141
  misc_feature [331]..[331]: allele = t, in linkage disequilibrium with rs10510558, respectively
  misc_feature [331]..[331]: n is a, t, c or g
caagtaatggaatattcacaacatcaaaatgcagaaggttacttgtcttgtccagggacatattattgtaaaatcaacactgaaacttggatcttctgccttcaaacttccttctactcaccacacagcttcttgggtgcatggccacttcccccactgcatcataaatgccttgagaacaaaggatacctcttgtcctgttttctttttctctcttgcacccactgctgcatcttaagcataatgggtgcttaatgtagttgagataattgtgtttctttatcatttggttacaattttaataggttgttctaggagttcagatgcttcnagggaaagaaagggactcttgattgagaaaagttcttaagggatcttttaattgtacaaaaatagattccaaagcaaatctagggaagagatagttactactgatctattaaaaaaaaaaaaagttaaatgtttttctctgacagcttgggagaaagattgggaccaaaagggagaaaatggtaaagaaagttagagtggttttgagaaatatggtggatggccagagccaatgaagaatgagaaggtcttggtggtgaggatggttgaggactagtgatatattagcttttaggcatttcctcctctgctctgtgttgtaatatcactg

SEQ ID NO: 482 - DNA, 661 bp, Homo sapiens
  LOC442077
  misc_feature [331]..[331]: Chromosome 3, SNP identification no. = rs1436239
  misc_feature [331]..[331]: allele = g, in linkage disequilibrium with rs10510558, respectively
  misc_feature [331]..[331]: n is a, t, c or g
aattgaccgggaatggaagtcccagagaatgtccaacatcagtccataactaatccaaatcagtagatgtccggactcaccccttccaggtgaaagttcaggttcgacaaagaaacgtcctaagtcaaggagtactcgacaatctacctcccagaatcaaggagatgaccacaaccggtttccggtttgagtaaaggtacacccgaagaggtcgtaccgtcaaatgaagtagttacgtcgttttactcttcctccctccttacttcccttcctctctctaacggtcgtcctcttttcagtatcagaaaatattggatacgaacctttactngatggtagtgaaaacggaatacgataaacaatcctctttcagtgatccaggtgaggtacacatgtttcccttctctaataagttccctcacttacggtcctccacccctagtgactcgcgatgatctcttccgacggacggggtgagtaggtttacgggttttcatctcaacgaatcgctgtacagacattaggacagacccgggattgacttacggtaagtgtttgacgggggaatcttcccggacaccgacaaggactactaccttattaggtcgagtcatgtcgtcggggtgtcgtctactggcataactagacgtcgaattttaaa

SEQ ID NO: 483 - DNA, 661 bp, Homo sapiens
  misc_feature [331]..[331]: Chromosome 3, SNP identification no. = rs9828340
  misc_feature [331]..[331]: allele = a, in linkage disequilibrium with rs4404442, respectively
  misc_feature [331]..[331]: n is a, t, c or g
actacattggtatagtgctgttgatatgatttctttcccctgtcccaaataaattatttgccttgcatggaaatacttactcactgctgtctcctgttggctcatattaatgcctagtttaaatttttaaaaaatcacataaatgttgtgggaagggacattgaagatagaacaacaggtgttatctatgaacatcaaaattcacccaatcagctaatgtgtattaaatacctacaacatgccatatatttcaaaactgggactaagctttggaaagtacaatgaatgtatatggcatataagccactaaagctatattcatacaatgaanttctgcttagaaataataaggaatgcactattaatacatgcaacaacatagatgcatctcaagaacatgctgagaacaaagtcagacactaaagattatacattgggtatgttcattgttatgtaattaataactgaataaaccagacaactatcaaatagtctcataattttgaagctggtttgtgagaaattatccttggccatacaatctaaaggagactctattttttctttttctttttttttttttttactgataaatatatgaaaggatctttattcccattgattaaagcaatacaaattaaaacaatgcaatagcttttgt

SEQ ID NO: 484 - DNA, 661 bp, Homo sapiens
  misc_feature [331]..[331]: Chromosome 3, SNP identification no. = rs12631618
  misc_feature [331]..[331]: allele = c, in linkage disequilibrium with rs4404442, respectively
  misc_feature [331]..[331]: n is a, t, c or g
ctgatgtacatgttaggatgggtgaaatgtgaatgacaatttggaatgactcttccttttaagtgaatgcatggatatttttggaagccaaattgtcttgggaacttttgatatatctagaaattggtagcattgtgttgtttacttcaaatttgaaaactgtctatgggaacatgactttgagtcaaactcattcattcccttatccagtaacatcaattgatcaataacctaaggcctgactgtagtcagtgttgggtatacaataggaagaaacatagtgtcttccctaagaaactcatcatcttggaatgggctgaaaggtacttangttcttttcccgtgactctgtcagccaacattctgtatgaggataactaaagggagtttgaagaactgagtcttcattctggccccacctgcattgtggtccagccttgtgcctggagggcagggtctgcagtccagtagaacttggttttaatccctgctccgcttctcagcggtgtcatcctggacagtttacctagtctctctgggtttcccatatcaaaaatgatgccaataaaaggccttttctcagagttgtgagaattcaagagttatcatatgaagcttttatcatagcggctcacacatgctgaatgcttggtaagtgctc

SEQ ID NO: 485 - DNA, 661 bp, Homo sapiens
  misc_feature [331]..[331]: Chromosome 3, SNP identification no. = rs6807315
  misc_feature [331]..[331]: allele = g, in linkage disequilibrium with rs4404442, respectively
  misc_feature [331]..[331]: n is a, t, c or g
tccctgatattactccaaatggtgcttaaaaggcccatgcttgcaaactatagtgctttgtcctttgcctggctctcagatgatctggtttctgaagaggagagagaaggctctgtccccttgccttcaaattggcaatccccagggatgatttatcctgacagcacaactctgcagctctgctctagtcttggaatttgctgactaggtacagttactgatggaaaagataccaaagcaggaaaaattcaaaaccatggaaacatgatcaagtttctaaacataagctcaacatacccttccacacaccttttattcatgcagagaatcntgttcctctatcaaagacccacaacctgaccttctttaagtaaacttctgctcattcttcaagattcagcgcaaatgtcaccggtacctaaagacttctttgagagctgagtggagaactttaatatgttcaaagcagttattcatgtactgtatctccccctcactagcaggtagtccttttcagagcaaggacacattttgttcaactttctatctctaaaccatttactgaagagagaacagaatctgacactcagcaggtccctgcttgctgctgccatgcctggaggttcaggatcttgattcctctctcagggcaggaagattg

SEQ ID NO: 486 - DNA, 661 bp, Homo sapiens
  misc_feature [331]..[331]: Chromosome 3, SNP identification no. = rs4312654
  misc_feature [331]..[331]: allele = g, in linkage disequilibrium with rs4404442, respectively
  misc_feature [331]..[331]: n is a, t, c or g
ccttgccttcaaattggcaatccccagggatgatttatcctgacagcacaactctgcagctctgctctagtcttggaatttgctgactaggtacagttactgatggaaaagataccaaagcaggaaaaattcaaaaccatggaaacatgatcaagtttctaaacataagctcaacatacccttccacacaccttttattcatgcagagaatcgtgttcctctatcaaagacccacaacctgaccttctttaagtaaacttctgctcattcttcaagattcagcgcaaatgtcaccggtacctaaagacttctttgagagctgagtggaganctttaatatgttcaaagcagttattcatgtactgtatctccccctcactagcaggtagtccttttcagagcaaggacacattttgttcaactttctatctctaaaccatttactgaagagagaacagaatctgacactcagcaggtccctgcttgctgctgccatgcctggaggttcaggatcttgattcctctctcagggcaggaagattgggcagctcaggggctgagcatgaaggatttttaacccatctcttgcttttgttattttccttgtcactgataggtatcctttggattcacttttcttcatatcagagtggtcagctct

SEQ ID NO: 487 - DNA, 661 bp, Homo sapiens
  misc_feature [331]..[331]: Chromosome 3, SNP identification no. = rs4583651
  misc_feature [331]..[331]: allele = c, in linkage disequilibrium with rs4404442, respectively
  misc_feature [331]..[331]: n is a, t, c or g
cagagcaaggacacattttgttcaactttctatctctaaaccatttactgaagagagaacagaatctgacactcagcaggtccctgcttgctgctgccatgcctggaggttcaggatcttgattcctctctcagggcaggaagattgggcagctcaggggctgagcatgaaggatttttaacccatctcttgcttttgttattttccttgtcactgataggtatcctttggattcacttttcttcatatcagagtggtcagctctgactcatgtgtgggaaggggatctggacaaatggacacctctcatctcttgtttaattccaagtanttaggtgttttaaaatctaactgggatttgttttaatcaagcatggagatacatgcagatgtggaaatggcaggaagactgtacgtattcagatacctagaaacaggaagcccagcattccacatagggccacatgaggaagccgtagggtcaggaggaggcagagtaaggaaggaacatggcaaggcaagcacccttattgtggtttctgcaggaagaaatgtgacaggtggggtaaacagggttagaactggctagttggggtactttcagtgggctctgggcctgggagctgttcctagttgtctggtaccttgccctggggtgatt

SEQ ID NO: 488 - DNA, 661 bp, Homo sapiens
  misc_feature [331]..[331]: Chromosome 3, SNP identification no. = rs13072243
  misc_feature [331]..[331]: allele = c, in linkage disequilibrium with rs4404442, respectively
  misc_feature [331]..[331]: n is a, t, c or g
aaggattggtcactgaattgccttacaaataagcactgccaataaatggaagtatttgtttacaaatcagcttgtcagagaggctgggatcagagaaatttggaagctaagggttagaggatagcagactcatagatcttgccaaggtcaatcaaaaatgataacaaaaataataagtctctggggaaataggattggtttacaaatctgcacgaaatttttacagattgcctctgcaaagcggggatctctgatattgtggtgaaggttagacagggaccctgcatccaaaaagctgaacactcaatttttcagtcattagaggggatanaaataactgatggtgggcagtcagtctgtcataaatttgtagcagggagattcatctgaggacaagaggagattggggttatgggctgataccctttcctccccacgcaaacttcgacttccataaattgatgtgtgtggtagattgattgcaaaaataacctccgttctcatctgccttttccctgtagcgacacctattgcatggccaattgttgtcaatgatttgctctggccaatagaatatggtagaagggaatgtgtgtcagccccaaatctggcctcaagaggcttaggcttacctgcttctgctttttccctcaggactctg

SEQ ID NO: 489 - DNA, 661 bp, Homo sapiens
  misc_feature [331]..[331]: Chromosome 3, SNP identification no. = rs4613448
  misc_feature [331]..[331]: allele = c, in linkage disequilibrium with rs4404442, respectively
  misc_feature [331]..[331]: n is a, t, c or g
ctggaatccaaatttatgcaagatcagccagaaggcaattttcattttatccaggataaaccagagcttaagctcccaaagcctgtcatcttgaatgtctccaatagtcactcaaattgttggtgcactcttgtttagcatgtttattacaattgtcatgctgtcttgatttttctaaaattacaatctcattattacaggattttctgttgaatgacacttcataaaaaagactttgattgctgagttacaaagacaattgtatcttcttgtaaagcatacagtcttggtggtcctaccccatgaactggctgtcccaggacggttttanggtgaggcattagtcgtgtattgattttcttcaatcttcagttgaatatttgtagtaattgctgtttcagcaatggtgaaccacatagcattgtcagaacctgactcattctgtttcatgatggttagtctctgttggccctccaaatacgtctctaccctcactacttacctttgtgccctgggaggctgatctctgtggacttaaacatctaaggtcccttggttcttggcttctggctgggtttcactaattaaggggcactgagggaggatgaaaaacaagaggagagtgagtttggggtctttgttaccctggctcatactttgc

SEQ ID NO: 490 - DNA, 661 bp, Homo sapiens
  misc_feature [331]..[331]: Chromosome 3, SNP identification no. = rs4404442
  misc_feature [331]..[331]: allele = c, t
  misc_feature [331]..[331]: n is a, t, c or g
caaaacatcatcttgtgctttcctaggaatggagaccatttaaattcttatttcctttggtttgtggaagtttatcaattgctttgctcagcatgcagtttcatcacttccaatctcagaaaagtgtcatacagaggtaatattcaaagactgagaattcaataaggtttccactcatcccaaaactccctcaagttaaatggtttaacttttatactatcaaccaacttggctgtgagcacatcagcagcaaggacggcattctattcatcttcagtgttgctacttagattccataagtgggttgaataaatgaaatataaacctctanttgatccaattaatctaaactatcatcttttaaacactcgggattcataccacacaatttccccattcttttccttgttattgaggctgatcttaaacagcatgaaatgagataaaatgtaacaattatctgataaattgagtaagagaagatggctaaaatagatgaatatattatactcaagagattgatatatatatatgaaatgttttctatataataaagtcaaaatcaattatgtccatacaaagattgtacaagaatattcacagaagctttactaagaatagttccaaactggaaacagtgcaaatgcccatcaaaaggaga

SEQ ID NO: 491 - DNA, 661 bp, Homo sapiens
  misc_feature [331]..[331]: Chromosome 3, SNP identification no. = rs13091015
  misc_feature [331]..[331]: allele = t, in linkage disequilibrium with rs4404442, respectively
  misc_feature [331]..[331]: n is a, t, c or g
tgaagagagaactcctgctccatgggctccttgtttattcctacctcccaggctcaccattgtaatctgacttaggaggccaccaaagccattcctgtgatgctctacagcagaggttggcaaacaacagtccacaggccagatttggcccatgacctgtgtttgtaagtaaagtttgattgaaacatagccacatccattcatttacatattgtctaaggctgccttcatgccacaaaagcacagttcagtagtggcagcagagtccatacggtccacaaaaccaccatctttactctctttccctttataaataaagattttggaccantgctctacatctcactgtctcctttgctgattctgccccatcttcctgatttgtgaacactaccatctactagggcttagttcttagacattcgtcatctcttcattgattccttaggtcaggggttctcaaccccagctgctctgaagaatcggttgggatgcttttttaaaatatcactgccttggtgtcacccccagaagtttcgatttaattggtctggcatagggctcagtcctcagtactttctgaaagtttcccaggtgattacaatgtacagccaggattcagaactattactgtaggtgatttttgtctactctcaaggct

SEQ ID NO: 492 - DNA, 661 bp, Homo sapiens
  misc_feature [331]..[331]: Chromosome 3, SNP identification no. = rs9814898
  misc_feature [331]..[331]: allele = c, in linkage disequilibrium with rs4404442, respectively
  misc_feature [331]..[331]: n is a, t, c or g
atcacatttattttatttatttatttattttttgtttatttttgttaagcattgtatttatatcaacttactatcattttcttcttccttttttttttttttttggtactatgctcctttttttttcttctgccttgaaaataaatattccttgaattaaaatacaagaatgaacagaaatgaatactgttccaaaatctgaaaacacatttttcccccattaccagtggatcttgatctgctccagaaattctttatgatgatggagggaagagcaaacaaatcgataggtagggacagaaacattgactacagttgaatagaaacagtngtactttctaaaattctttccaatgtccttatatttcttgaattatgtatcatgtacatcttcataaaatgtcaccaatgtctcctccagtcagtctgtaactgctatatctgtgaaattatttgtcttgagccacataattgcatattgtgagcaactcatctttcagaagctagaggaaagaaactcaatctcaaaattacacctttcttatctatagatgagggggaaatgtcttatatatactgtcactttttctcagcaaaaccaccatctctttaaaaatcatggtttgaaagcagtaaatgctgcagaacaacaagctgtcag

SEQ ID NO: 493 - DNA, 661 bp, Homo sapiens
  misc_feature [331]..[331]: Chromosome 3, SNP identification no. = rs17067503
  misc_feature [331]..[331]: allele = g, in linkage disequilibrium with rs4404442, respectively
  misc_feature [331]..[331]: n is a, t, c or g
ttttttttcttctgccttgaaaataaatattccttgaattaaaatacaagaatgaacagaaatgaatactgttccaaaatctgaaaacacatttttcccccattaccagtggatcttgatctgctccagaaattctttatgatgatggagggaagagcaaacaaatcgataggtagggacagaaacattgactacagttgaatagaaacagtcgtactttctaaaattctttccaatgtccttatatttcttgaattatgtatcatgtacatcttcataaaatgtcaccaatgtctcctccagtcagtctgtaactgctatatctgtgaanttatttgtcttgagccacataattgcatattgtgagcaactcatctttcagaagctagaggaaagaaactcaatctcaaaattacacctttcttatctatagatgagggggaaatgtcttatatatactgtcactttttctcagcaaaaccaccatctctttaaaaatcatggtttgaaagcagtaaatgctgcagaacaacaagctgtcagaggaaagacaggggacatttaagaccttgcataacatttgtaaaaattctcagcgtcaaagcagaaatcgtcatcttgagaaagattgcactgaattcaaatgactgacttttacata

SEQ ID NO: 494 - DNA, 661 bp, Homo sapiens
  misc_feature [331]..[331]: Chromosome 3, SNP identification no. = rs10510890
  misc_feature [331]..[331]: allele = t, in linkage disequilibrium with rs4404442, respectively
  misc_feature [331]..[331]: n is a, t, c or g
aaaggaaaaattaaaaatgaaggaaaataatactaaatcatgctgaaatcatccagaagtaaaatactaaataaatatataaagcaaatggcttgcactttaaaagaactgcgtaactaaaacaagacaaagacattttctttttcttctttaaccaacctgagctggcagcaagataagctgagtttaaagtatttaaaaagattgaaaatgattcaatttagctgtgtgatcttttttacacaggcattaaagaaaataatatcatttctcatgaccaagctttctacccttgtggtgtgtgtttcatctgaaagtctctatacatatngttgttatcggattggacaaaaacaaaggaagaagaatatctgcaaagctaatgttgatgagtaatttaaatgataactaagttgcgaatggcatttcaatttgttttgcccatttaatgacataagtagagattaagtccaaaaatttaattacttattaagtggcaataaaacataccagtggtttttgtccagttcttttcttattttagacacacttgtaaattctatataaaaatgtatcctcttcctctccactcccacgcactcctgcacacacacaaactcatctatgtatttatggtttagtatagggtttgcaaactcat

SEQ ID NO: 495 - DNA, 661 bp, Homo sapiens
  misc_feature [331]..[331]: Chromosome 3, SNP identification no. = rs9821058
  misc_feature [331]..[331]: allele = a, in linkage disequilibrium with rs4404442, respectively
  misc_feature [331]..[331]: n is a, t, c or g
atttctcatgaccaagctttctacccttgtggtgtgtgtttcatctgaaagtctctatacatatcgttgttatcggattggacaaaaacaaaggaagaagaatatctgcaaagctaatgttgatgagtaatttaaatgataactaagttgcgaatggcatttcaatttgttttgcccatttaatgacataagtagagattaagtccaaaaatttaattacttattaagtggcaataaaacataccagtggtttttgtccagttcttttcttattttagacacacttgtaaattctatataaaaatgtatcctcttcctctccactcccacncactcctgcacacacacaaactcatctatgtatttatggtttagtatagggtttgcaaactcattgccttgaaggacaaagcaagtaataaaaaggaagagagaaagctctgtataagacaatagggagtagtgaggactgtggcaaacttggctaagcagctcactggaaagggtggcccctaatgatctccagccaattattgacacatgagaatataacacagtattaccttctcaaaatcttattttgtaagaggagttatgaatccatgtgtattacgagatctccctatgttggaatattgtcaactaattcaactaaatgaac

SEQ ID NO: 496 - DNA, 661 bp, Homo sapiens
  misc_feature [331]..[331]: Chromosome 3, SNP identification no. = rs10510891
  misc_feature [331]..[331]: allele = g, in linkage disequilibrium with rs4404442, respectively
  misc_feature [331]..[331]: n is a, t, c or g
tggttacccagtgccgctctaactgcttcttctactctgcctcaattgtaactttgggctaaagcaattagaataattttcagtaggtcaggtcatgacgatgaaatcaggaccatagttttcaatttactaaaaatctactttctagaattcctggagggcatagcctattccatacctgtccagaatacatcatagccctcatcataatcatattcttaagtatatttaataaataaatgactgaataaagaaatcattctattttggacaaagaggtcatcattcagaaggccacaataacatggaggaaaactatttcaggaataantaagctgaactcaggtaaactgccttatcatccactagaaaccacattaaaacaaaccaaacaaagcaaaactaaactgcttcctgctagctctctgacttagaactgaatagagatacagtctttcttggatctgatttctgattgctccttactaatgctgaaaattgaattcattggctccatcaaagtgccctgcagagaggagtagaagccctggctgaatgtaggagataaaaaataagcttgatagtaaaggtggcttacttgatagtccacagaaagatagccaagtcaagcatgcccttatttatggcttattaaagacaa

SEQ ID NO: 497 - DNA, 661 bp, Homo sapiens
  misc_feature [331]..[331]: Chromosome 3, SNP identification no. = rs13084396
  misc_feature [331]..[331]: allele = t, in linkage disequilibrium with rs4404442, respectively
  misc_feature [331]..[331]: n is a, t, c or g
ataagatgaataagacaagtattgtttaattcttataaagttaaggatttgtttgacatattttatagagtatcaagcagaatatataaaccatacacatgacagtaaataaatatgataaagtatggcatcaatattctggttttgatgtaacaggggtgtatttcccttctataaaatattccttgttgcataaaatttttaacaaccaccttttcattttttttctaatatactcataaaatgaggtctcagcagaacatgtaggggaagatagtgaattttatttatgattatttggttctagacttctaggtaactggttaaaagntcaggtagtgagtggataaaaaatagatggagtgtgaccagagacttgctcaatgctgcggtccaacatccacgttgataatggctacatccagtttaactgtttatgtagcttctactgatttcagtagaatcagaaacagattttgggtttcaaattttctgtttgtgtaacaggacattaacagtgtcctgttaatgagaaaagattcttctgtactgagatgagaaatgaattgcattgggttattcagattatttcctgtgtatgtgtttcctatgtatgtgtatgtatttcctgtgtatgtgtttcctgtgtatttcctgtgta

SEQ ID NO: 498 - DNA, 661 bp, Homo sapiens
  misc_feature [331]..[331]: Chromosome 3, SNP identification no. = rs4147406
  misc_feature [331]..[331]: allele = c, in linkage disequilibrium with rs4404442, respectively
  misc_feature [331]..[331]: n is a, t, c or g
cttaccctatctaggtctgtttactgtagtacctttaacctccttgcaagggtttcaactcatttttagcttcatggcaacaacataacttcataatgtcagaaaaggtaggggcttagcgatggtcagaacgttatgatcatttatgtcatccataaaaaataaaccctggaaaaatacctgagtctacttcaagtccagcagagagcctcaggtatattttctcccctcagttccttcttctaatcccttttgtttttgtttctatggggagctatgctgtttgatcagccacagctcactgttaattcagattatgtttacaagccantaaaaccctcagccttcataacacatgaaactgataagttttattttcttcttgctctatggacacaggtgaagtttttggatataagtgctggaattatatcttagttaagagtatccgtctaattgttctaatttttgttcttcaatgaattatagacagtcccaagaattacaaagttttatcaggtcgcatccctaatcctaaagagcaaataagcatgaaggggttattgactattttttgaattactcagtttgaacatgattcctccttgggatgaatacttcttggctcctcagcctcttactacaaaacccaagggaggcg

SEQ ID NO: 499 - DNA, 661 bp, Homo sapiens
  misc_feature [331]..[331]: Chromosome 3, SNP identification no. = rs2367590
  misc_feature [331]..[331]: allele = c, in linkage disequilibrium with rs4404442, respectively
  misc_feature [331]..[331]: n is a, t, c or g
gggttagttaatgagcaatggcttcaacttaaagtcactaactgcattagcccctaataagacagcctgtcctttgaagcctcaaagccaaacattgacttctccgtacctatgaaagtcctggatggcatcttattccagtataaggctgtcttgtctacattgaaaatctgttgttgagtgtagccaccttcatcaatgatattagctagattttctggataacttgctacagcttctatatcagcacttgctgcttcaccttgcacttttattttatgaagatggcttctctccttgaacctcatgaaccaaattctgatagcttcanacttttcttctgaagcttcctcatctctttcagccttcacagaacttaagacagttagggtcttgttctggattgggctttggcttaagggaatgttgtggctggtttgatcttctatccagaccaataacattttctccatattagcaataaggttgtttcactttcttagcatttatgtgttcactggagtagcacttataattttcttcaagaactttttctttgtatgtacaactgtttggtgtaagaggcctttttacccatctcagcttttaacatgtcttcttcactaaacttcgtaatttctagcttttgattttaattgag

SEQ ID NO: 500 - DNA, 661 bp, Homo sapiens
  misc_feature [331]..[331]: Chromosome 3, SNP identification no. = rs17067527
  misc_feature [331]..[331]: allele = c, in linkage disequilibrium with rs4404442, respectively
  misc_feature [331]..[331]: n is a, t, c or g
agacccaggctgcttctcttctcctctgctggtgtcaccatggagtgaattcccatcatctcatgactggaccagtgcaatagcctctgcctggctctggctccggctccatgatctcaccttgtctggctctatactctcacgtggcttcctgcagcccactgagctaccacttaaatctgcaagtcagattagcccattccagtggataaagtccttcaatggcttcccgtcacattaacactcaatcttcaacctctcacttgattgcctctattttcaagtcccgtatccccatgttcctcccgcccccaaactccagcggtgccantcctgcttctcctcaactacaccaagctttgtcctacttctgagcctttctacttttagagttgctagatttaaaaagctgtttgttacctgggatatagaaaaactgtttgttgtttctctgaaattcagattaaactgggcatcctgtatttttgttccccaaacctggagccttctgtttgttgttccttggtctgacagcaaactgaagagggaaccctaaattacaaaattttccaagtttaacctttctccttttttacttcttactttcagtttttaatttatctagaatttaaaaaatctacagagagaagtaatagtactg

SEQ ID NO: 501 - DNA, 661 bp, Homo sapiens
  misc_feature [331]..[331]: Chromosome 3, SNP identification no. = rs12488885
  misc_feature [331]..[331]: allele = a, in linkage disequilibrium with rs4404442, respectively
  misc_feature [331]..[331]: n is a, t, c or g
cacaatgaagacttggcttattgttttcctgtttctgtttgaacagtgaactgatttgtaaagaaccttcattgtacctttcacttctctgactccctcaatgttccttgtgttacctccagtatgacaatgggacccatgggccacatgagcttatcacttagagaggcatcgatttctcccttttttagaatagcttcataagagccatcaacattttaatagagtcaggtatctattgggaggtttataaacctgggaaaatgagtttgtgttccacaatgtagacacagatattttttattaatttagagagccaattcccccaggnaaatgagattctgcttgagtgttcagcttgtctttcaatagttctgaagacttatgcttggatttgttgaataggcctatggggcctacagaaagatgcagcgtttctataatttggggaagcttggagccagacataaggtgaaattgaaaatacacagcactatgacaagaattgtcgacagaaccaagagagggagagaaagagagtgagaaagtaggagagaggaagagacagagacagagagcaacaaaggatttacttatcctgtgactgataattccagaggtgggtctggctcaggtatggtttgctataggggttcaaatg

SEQ ID NO: 502 - DNA, 661 bp, Homo sapiens
  misc_feature [331]..[331]: Chromosome 3, SNP identification no. = rs17361212
  misc_feature [331]..[331]: allele = a, in linkage disequilibrium with rs4404442, respectively
  misc_feature [331]..[331]: n is a, t, c or g
ttccttgtgttacctccagtatgacaatgggacccatgggccacatgagcttatcacttagagaggcatcgatttctcccttttttagaatagcttcataagagccatcaacattttaatagagtcaggtatctattgggaggtttataaacctgggaaaatgagtttgtgttccacaatgtagacacagatattttttattaatttagagagccaattcccccaggcaaatgagattctgcttgagtgttcagcttgtctttcaatagttctgaagacttatgcttggatttgttgaataggcctatggggcctacagaaagatgcagcntttctataatttggggaagcttggagccagacataaggtgaaattgaaaatacacagcactatgacaagaattgtcgacagaaccaagagagggagagaaagagagtgagaaagtaggagagaggaagagacagagacagagagcaacaaaggatttacttatcctgtgactgataattccagaggtgggtctggctcaggtatggtttgctataggggttcaaatgatgtcatctcacttgctctgtcactaagcttcacttccctcttggttttattttcaatgaggttgcttctaaaatggtgccataatgactgccaaacattcca

SEQ ID NO: 503 - DNA, 661 bp, Homo sapiens
  misc_feature [331]..[331]: Chromosome 3, SNP identification no. = rs11130909
  misc_feature [331]..[331]: allele = g, in linkage disequilibrium with rs4404442, respectively
  misc_feature [331]..[331]: n is a, t, c or g
ttttttttttttttttttttgagagagagtcttgctctgttgcccaggctggagtgcagtggcacaatctcggctcattgcaacctccacctcctgggttcaagcaattctcctgcctcaacctcccacatacctgggattacaggtgcatgccaccattgtttctattttttaaactgagttattcataagcaagatcatcctcattgaagctatttactcaggcatcatcagccataccttacaatgaagaaattaaggcttagagaagggaaggagggcaggtcccagattttctgagctccacatcagcctactcaggaagtcctgnctcacctctaagcttcactacccatattgtgctcttccatctccctacaggtcctttaagtcaagcccagaatgggaaaaacaaacatcagaccaacctgtgtagctgtttagagctaagtcattggagccagactgcatttgttccaataccaactccagttcttacttacgggttatattaaattctctggggcttagtgcctgccccaaggagctgctacggtacagatgaaattaatcacttttaagcacttctaaaagtgctcagaacagtgcctgacacataatatgtattcaaagaccccatttgtacagcgttctttgctat

SEQ ID NO: 504 - DNA, 661 bp, Homo sapiens
  misc_feature [331]..[331]: Chromosome 3, SNP identification no. = rs13099709
  misc_feature [331]..[331]: allele = g, in linkage disequilibrium with rs4404442, respectively
  misc_feature [331]..[331]: n is a, t, c or g
gctattacttgccagggcttcatatcatacaatacagaaaagtccctgaggaatatctggtagtgaatgccctttgtctcacatggatgtccctctttcagcacttaaatctacactgagtatattttactagtttgttcctacaccaatagacagtttacttcagatgactttggacacttcctatagagttaatcagctggcttacagtaatgagcatgagggtagtattaaaaaaaaaagaaaaataaaaagcctggatgtcgtatagtcaagtaggggtgagattgaatccaggcccagtgtgcttaagacctgtgtgactttaggnaaattacttcacttctccgaactccattttcttatctgaaaaatgagaatagaaacattttcctaactcagatgatgtgaggatgcctactgtgcatagtaaatgcatggcacacaggagaaagaggcagccttcttaatcataatttaacaaacctcggatctttgtttcatcattgtttccttgttatttgcttttgcctgtgagaacagcatctgctgaaggcctttcagaagattttgcctgctttgtgatggtccttgtgggcagactgttcacaacatgactacttactagccaactccttagtctccagacataaacatttat

SEQ ID NO: 505 - DNA, 661 bp, Homo sapiens
  misc_feature [331]..[331]: Chromosome 3, SNP identification no. = rs13079904
  misc_feature [331]..[331]: allele = c, in linkage disequilibrium with rs4404442, respectively
  misc_feature [331]..[331]: n is a, t, c or g
agctggcttacagtaatgagcatgagggtagtattaaaaaaaaaagaaaaataaaaagcctggatgtcgtatagtcaagtaggggtgagattgaatccaggcccagtgtgcttaagacctgtgtgactttaggcaaattacttcacttctccgaactccattttcttatctgaaaaatgagaatagaaacattttcctaactcagatgatgtgaggatgcctactgtgcatagtaaatgcatggcacacaggagaaagaggcagccttcttaatcataatttaacaaacctcggatctttgtttcatcattgtttccttgttatttgcttntgcctgtgagaacagcatctgctgaaggcctttcagaagattttgcctgctttgtgatggtccttgtgggcagactgttcacaacatgactacttactagccaactccttagtctccagacataaacatttatatatttactttttaagaacagtgcagatatatgtgatgattcaaaacagtcagaatgccaaattttgcccagtgataactgcttagccggtatagctcccttttttttttgaatcgctacatggcagatattttattcccgtgtctacactgagctgaggaaactgatgatcttaccggaaatgtaatttgctcaag

SEQ ID NO: 506 - DNA, 661 bp, Homo sapiens
  misc_feature [331]..[331]: Chromosome 3, SNP identification no. = rs2367591
  misc_feature [331]..[331]: allele = c, in linkage disequilibrium with rs4404442, respectively
  misc_feature [331]..[331]: n is a, t, c or g
tttgcgtcctatcagctcctttccctccctcccttcctcccttgtcctttccttcctcctttctttctctcccttacttttctccctcatactctttctccttctttcatccctgcttctttccctcaccttctcccttttctcctttttcattcaacaaggattttctaagaacctacacaatgccagtatcttctagatcttgggaatggaagaatgaaaagatgaaggaaacatttccagatgcagatgacttacagtctcaaaaagaatttgctagatgaaccctgggtgagtattaaccagacctcagatcttgagcaatccactnggtgtccatcccgattgatttcaagtaaagttctttggtttctttggaaacttcgacataaagggtcttgccagggaatttgaaattggggtatggattttttttcaatgcaagaaacaatgaaaatataaaaatatggaaacaactgaaagctagaattaggttatgaaactatcaatattattgttgcttaaaaagatagtgcagtcatatcatgtactgtgttaacttacctaaatttacctgcatatatgtttggcaaagagagacaaaagtggggtgggtgggaaagagaccacagagagagtgagcaatttaaacaatgcagga

SEQ ID NO: 507 - DNA, 661 bp, Homo sapiens
  misc_feature [331]..[331]: Chromosome 3, SNP identification no. = rs9850740
  misc_feature [331]..[331]: allele = g, in linkage disequilibrium with rs4404442, respectively
  misc_feature [331]..[331]: n is a, t, c or g
caagtaaagttctttggtttctttggaaacttcgacataaagggtcttgccagggaatttgaaattggggtatggattttttttcaatgcaagaaacaatgaaaatataaaaatatggaaacaactgaaagctagaattaggttatgaaactatcaatattattgttgcttaaaaagatagtgcagtcatatcatgtactgtgttaacttacctaaatttacctgcatatatgtttggcaaagagagacaaaagtggggtgggtgggaaagagaccacagagagagtgagcaatttaaacaatgcaggaagttcaggccatgttccatcanagtgtctgcttgagggtgatcttgacatatgatgggtatctactgttttcatgtttatttcacactgtgggcacatggccatgcataatgtaattctagtgtttaaaagtcattatttttaatttaccatgccccaaaatgccaaggatctggtactcaactgaagaaagggtcatctggaaagctgtgcaggactaatggacttcaatgtgtcagtctctaatgcagtgtcatttaaggacttgtcaaggggctaattttgactatgcatatttttcatcttatgcacttactttggaagcacagtctctcagggtaagggacacccct

SEQ ID NO: 508 - DNA, 661 bp, Homo sapiens
  misc_feature [331]..[331]: Chromosome 3, SNP identification no. = rs10510892
  misc_feature [331]..[331]: allele = t, in linkage disequilibrium with rs4404442, respectively
  misc_feature [331]..[331]: n is a, t, c or g
attgttgcttaaaaagatagtgcagtcatatcatgtactgtgttaacttacctaaatttacctgcatatatgtttggcaaagagagacaaaagtggggtgggtgggaaagagaccacagagagagtgagcaatttaaacaatgcaggaagttcaggccatgttccatcacagtgtctgcttgagggtgatcttgacatatgatgggtatctactgttttcatgtttatttcacactgtgggcacatggccatgcataatgtaattctagtgtttaaaagtcattatttttaatttaccatgccccaaaatgccaaggatctggtactcaantgaagaaagggtcatctggaaagctgtgcaggactaatggacttcaatgtgtcagtctctaatgcagtgtcatttaaggacttgtcaaggggctaattttgactatgcatatttttcatcttatgcacttactttggaagcacagtctctcagggtaagggacacccctgcattatgtttaaatttagagtctactaagccccctacataaataatggatttgcatctgtgaattgtaataatctctagaaggagataatttgcaaggacattaacttgataggcaagccactattaattagaaatcttaacatgttggcttgttaatgg

SEQ ID NO: 509 - DNA, 661 bp, Homo sapiens
  misc_feature [331]..[331]: Chromosome 3, SNP identification no. = rs2367592
  misc_feature [331]..[331]: allele = g, in linkage disequilibrium with rs4404442, respectively
  misc_feature [331]..[331]: n is a, t, c or g
gtcatttaaggacttgtcaaggggctaattttgactatgcatatttttcatcttatgcacttactttggaagcacagtctctcagggtaagggacacccctgcattatgtttaaatttagagtctactaagccccctacataaataatggatttgcatctgtgaattgtaataatctctagaaggagataatttgcaaggacattaacttgataggcaagccactattaattagaaatcttaacatgttggcttgttaatggctaattaagcctttactgagatccattgcaggtaagaggcaatgaagaacaatccaggaatatgaaatnctattcgcctttgaatttgattctgttcaaaaaaaagtatagaaagtctagaaataattataggtaagacaaaaacaagcctccagcaaattaaaaaggaaatcactgggaaaagtaaaagccatcaaaattaaaaatagaattcattacctgttcaaacagttgtattaccacgcaatctgaaaatactctcaggattgctttgtatttttattttactttaagtttcaggatacatgtgcagaatgtgcaggtttgtttcataggtatacatgtgccatggtggtttgatgcacctattgacctgtcatttaggttccctcccctcac

SEQ ID NO: 510 - DNA, 661 bp, Homo sapiens
  misc_feature [331]..[331]: Chromosome 3, SNP identification no. = rs11130910
  misc_feature [331]..[331]: allele = g, in linkage disequilibrium with rs4404442, respectively
  misc_feature [331]..[331]: n is a, t, c or g
tgtgtccatatgttctcattgctcaacttccacttatgagtgagaatatgcagtgtttggttttctgtttctgtgttagtttgctgaggatgatgacttccagcttcatcagtgtctgtgcaaaggacatgctctcattcctttttatggctgtatactattcaatggtgtatatgtaccaaattttctttatccagtaaatgcccattgatgggcatttggattggttacatgtctttgctattgtaaatagtgctgcagtaaacatacatgtgtatatgtctttatgatagaatgacttctattccttttggtaatgggattccccagnaatggaattgctgggtcaaatggtatctctggttctagatcttttaggaattgccacactgtcttccacaatggtggaactaatttacattcccaccaacagtgtaaaagcattcttatttctccacagcctcgtcagcatctgttgtttattcactttttaataatcgccattctgactggttgagatggtacctcattgtgattttgatttgcatttctctagtgatcagtgatgttgagcttttttttcatatgtttattggccacataaatgacttcttttaaaagtgtctgttcatatccttcatgtactttttgatggggttgt

SEQ ID NO: 511 - DNA, 661 bp, Homo sapiens
  misc_feature [331]..[331]: Chromosome 3, SNP identification no. = rs7372226
  misc_feature [331]..[331]: allele = g, in linkage disequilibrium with rs4404442, respectively
  misc_feature [331]..[331]: n is a, t, c or g
ttgctattgcttttggtgttttagtcatgaagtctttgcccatgcctatgtcctgaatggtattgcttaggttttcttctagggtttttatggttttgggttttacacaagtctttaatccatcttgagttaatttttctataaggtgtaaggaaggggtccagattcagttttctgcatatggttagccagttgtcccagcaccatttgttgaataggaaatccttttcccattgcttgtttttgtcaagtttgttgaagatcagatggttgtagatgtgtggtgttatttctgaggactctgtcctgttccattggtctacatgtctgntttggtaccaggattatgctgttttggttgctgtagccttgtagtacaaagtcaggtagcaggatgcctccagcttttttttttttttttttttttttttttgcttagaattgtcttagctatatgggctcttctttcattccataagaaatttaaagtagtttttttctagttctgtgaagaatgtcaatggtagtttggtgggaatagcattgaatctataaattactttgggcactataggcattttcatgatattgattcttcctatccatgaggatggaatgtttttccatttgtttgtgtcctctcttatttccttgatcagca

SEQ ID NO: 512 - DNA, 661 bp, Homo sapiens
  misc_feature [331]..[331]: Chromosome 3, SNP identification no. = rs13061838
  misc_feature [331]..[331]: allele = c, in linkage disequilibrium with rs4404442, respectively
  misc_feature [331]..[331]: n is a, t, c or g
gtctttatatttcggtttgtttttgtagtgggtggtactggtttttcctttccatatttaatgcttccttcaggagctcttgcaaggcaggcctggtggtgatgaaatccctcagcatttgcttgtctggaaaagattttatttctcctttgcttacgaagcttagtttggctggatgtaaaattctgggttgaaaatgcttttctttaataatgttgaatattggctcctgctctcttctggcttatagggtttctgctgagaggtcctctgttagtctgatgggctcccctttgtaggtgacctggcctttctctctggctgccattanctttttttctcttcattttgaccttggagaatctgatgattatgcctcggggttgaacttctcatggagtatcttagcggtgttctctgtatttcctgaaattttggggaagtccttttttataatatcctgaattgtgttttccggcttggttccattctccccatgtccttcaggtctaattaatcacagatttggtctttttacatagtcccatatttctcaggtgttttgttcatttccagctccatcaggttatttatgttcctctctaaactggttattctagttagcagctcctttaactttttatcaaggttcttagcttct

SEQ ID NO: 513 - DNA, 661 bp, Homo sapiens
  misc_feature [331]..[331]: Chromosome 3, SNP identification no. = rs6770985
  misc_feature [331]..[331]: allele = a, in linkage disequilibrium with rs4404442, respectively
  misc_feature [331]..[331]: n is a, t, c or g
gaaatgaaatgggaagagagggaaagagggaaagagagaaagaaggaaagaaagaaaaaagaaagaaaaagaaaatacaacaaaaagaaagaaagaaataatatagcatgacagcttcaagcttctatctagcaccactcatgcaattgtaggcaatatgaggctggagacatgttttagcttcaagcacaacactgcttgctgtccaacaaatagtaaattgtcctaaattgaattgaattgaccctaaaatgctgaaccaagagaaaatactgtctttctgtggttcctcaaagcagttctgaaagaaacgttcgtttgggatcaaatntaacttgccacttgctccttgtccaacaccaggctctcagagttaaagtaaaaattcaggattatcccttctgattcccctccatcagcactagacttaattatttataagtaatttgttggaatgtcagtgtttaagttttaaagctagtgatgattagtgatttgatacataataatgtttaataccaacaaaggagtaaaatgtttaagctattcgaccccctgtttttctttttctttttcttttttctttttttttttttttgagatggagtcttgctctgtttgcccaggctggagtgcagtggtgcgatctcggctcactgca

SEQ ID NO: 514 - DNA, 661 bp, Homo sapiens
  misc_feature [331]..[331]: Chromosome 3, SNP identification no. = rs1447443
  misc_feature [331]..[331]: allele = t, in linkage disequilibrium with rs4404442, respectively
  misc_feature [331]..[331]: n is a, t, c or g
aatgtgttaaaataaatatcttttaatttgaacattaaattttgtcagcctgtagcatgtcaattcaacatatctgttaaaaatgagatttttaggagctttcctgacatgtgtaattctaagaggttgcgaacagtattccttctcagaagcatgtcctctgtaatcatattacctggactaaagacagaggcctggtgctgagacttcacatttttattttggcattttaaaggctgcatatgtcttctccctgtcagactcttctccacttcgttttactctgcctcctggtttcctttcttctgtcacgtctccttagacaaagttncacttctcatttccatgaatccttggtctaacatcagttgaacattctctgcagtgcctggggctctttggaaaagagatgttatagaaatctaatgaataaataaaagactagctcataccctcaggtccttgtgttgcctagtgctgatgaagttagcaattttctaggatttgaataagtatattactgaaatgtagactatgaaacagagtaaacttcatttaaatgaggagaggctactgtggggtaatttcaaccacagtaaggccctaatcacatcttctgtgtttattttttcttcttggtaaggtatatgtgcccagttct

SEQ ID NO: 515 - DNA, 661 bp, Homo sapiens
  misc_feature [331]..[331]: Chromosome 3, SNP identification no. = rs12637433
  misc_feature [331]..[331]: allele = a, in linkage disequilibrium with rs4404442, respectively
  misc_feature [331]..[331]: n is a, t, c or g
gagagttagattcagtggtgtgctgagaactgactctagtattattacaaaaagaacatagtcattgcaacatttcaactttgttgatcccttaatatcagaaattctccacttaaacatatattctgatgtcaaaagattagaaagaactcgtttcccccgcgattttggcccaacacacaaggccttttaatcaccttagcacaggacagtgatctctttggaaaatgacaagttagttcattcctgcttctttccactggtgctggagcaacagggagaatggtgcaaattgcactctgtgaaataatgaagcaaataatgtctcttnaaatggaactgagcatatttacatctagaaatatgttctatatgaatgcttttattgtgcaaaaataattcactgacatggagataatgcagagtggagagtggaggaacagggaggattttatagacactcccattgagacagttttcctgaaatgagtcaggtttggtcttctaagctatatggatgatgtattttattggcttcactgtcattctaataagatgattttggtctcagatgtatctttttttttttttttttttttggtaaagccagggtctcacttgatcacccaggctgaagtgcagtgtgcatgatcatagctca

SEQ ID NO: 516 - DNA, 661 bp, Homo sapiens
  misc_feature [331]..[331]: Chromosome 3, SNP identification no. = rs4688357
  misc_feature [331]..[331]: allele = g, in linkage disequilibrium with rs4404442, respectively
  misc_feature [331]..[331]: n is a, t, c or g
tccagtcaaatgaactcgatagattagtaccacagcctagttctaaccttggccttgttctaacctagttctagtcatgggataaaattaagacagaatcttagggtatacaacatagacagtgacacagaacaaatctgaaataccagagagaactgagaagcttcagaacaacagcttcatccattctactctcagcaatcccaatccactcttaatgcaacatcgtaaacatataattttgcagaaagagatcattgctgtcacattttccccgtaccctgagagtccataatttgctctttaatatcataaacaggccaaggtcagnctccttgggatcttgtgccagatctaaacaactcttacatttaatataaacctgatgaattactggaagtgcactcaatatctaaaataatgtgtggcacatagtagatgatccttgttgcttcagaatatttatggaatgaatgcatgaataatgaagctcagaaagcaagcagaaaacagatcatgcatcttagaagaagactgcagtgttgcagcagagtggaaagcctcaggccattgcaataagagtatgcattctttgaggtatataagccatggaaacttaaggacaaaaatatctgcaaattgcattcctgtttctaatgtc

SEQ ID NO: 517 - DNA, 661 bp, Homo sapiens
  misc_feature [331]..[331]: Chromosome 3, SNP identification no. = rs881603
  misc_feature [331]..[331]: allele = c, in linkage disequilibrium with rs812824, respectively
  misc_feature [331]..[331]: n is a, t, c or g
aaactcagtgaattggagtaaagcaatgtaagcggtagcttcatcttcaaagatgccatgtaaaatatacatattaacaagcagggttggttttttttccttttgttcttaccccttctgtttgtttctctgctctgttccaagtactggcatttcttagtagtgtaaatatccactagagtttacattttccttcatccacaatcatctcccaaccttgaagttttcaccactgccctcttgggttcctccagcggggactgaacttccagagccaataaatttttcgaacctacatctctttcctcaaagacagtacctggtaaataangcccaggttaaactgcttatatttaaaaaagcaaataagccaaaaaggcatgtttgtgggtgtgtgtcttcatgattctctctgtaaatttttattgaataactgattagaccacaaacaagcagagtcgtagatctgaaacaaggatctaatgtataaattcaagattttacatacacatttcaaaactggagagttacatacacatttcaaaatttgggagttccactacaccatactattcccattttggtggattgctgtagataagattcgggattccattcatctcatcctgaccacacaccatcctttgcaaagggtaggtgg

SEQ ID NO: 518 - DNA, 661 bp, Homo sapiens
  misc_feature [331]..[331]: Chromosome 3, SNP identification no. = rs881604
  misc_feature [331]..[331]: allele = c, in linkage disequilibrium with rs812824, respectively
  misc_feature [331]..[331]: n is a, t, c or g
aagcaatgtaagcggtagcttcatcttcaaagatgccatgtaaaatatacatattaacaagcagggttggttttttttccttttgttcttaccccttctgtttgtttctctgctctgttccaagtactggcatttcttagtagtgtaaatatccactagagtttacattttccttcatccacaatcatctcccaaccttgaagttttcaccactgccctcttgggttcctccagcggggactgaacttccagagccaataaatttttcgaacctacatctctttcctcaaagacagtacctggtaaataatgcccaggttaaactgcttanatttaaaaaagcaaataagccaaaaaggcatgtttgtgggtgtgtgtcttcatgattctctctgtaaatttttattgaataactgattagaccacaaacaagcagagtcgtagatctgaaacaaggatctaatgtataaattcaagattttacatacacatttcaaaactggagagttacatacacatttcaaaatttgggagttccactacaccatactattcccattttggtggattgctgtagataagattcgggattccattcatctcatcctgaccacacaccatcctttgcaaagggtaggtggatggagtcaggaagcaggac

SEQ ID NO: 519 - DNA, 661 bp, Homo sapiens
  misc_feature [331]..[331]: Chromosome 3, SNP identification no. = rs1081903
  misc_feature [331]..[331]: allele = t, t, in linkage disequilibrium with rs1402582, rs812824, respectively
  misc_feature [331]..[331]: n is a, t, c or g
agagacatccactatgctcttccctatttcaaaggacccccaacatttagccccagtagcccctgaagaagccagtgatttcccaagaatataaaagacataaagggcctcctaaaactgcccagactagatctagttcctaggttataaatcctattaaaaatgagaacaactaagagaaaagccaagtctctaatatccacaaatgcctaaatactgtctcctatgaccattaccactgctccaccaaggttcctaagatgattgatagatagatagaacaaagccaaaaatgcatgatctttattaccatgagttgtttaccccaatnccaatgtggtccttggtgaccagactcaaccacatggaagaccccttttgcctaagaggcatataagcatagcaaactcagagaccccctagatccctttcccataagctgacactcacatcttaatcctctgaatattaccactctaatgggaaggaaaagcaattccaaggaaaagcacaccaagaaaatagtttcttcccaccatccaagcttacacaccaaggcaggtaagctcttcccaggaggaaaaaagaagcaaaagaatagggttacccttacgcctctcaccaaggcccaactccaggtaatatgggccaataaatgtcc

SEQ ID NO: 520 - DNA, 661 bp, Homo sapiens
  misc_feature [331]..[331]: Chromosome 3, SNP identification no. = rs1402582
  misc_feature [331]..[331]: allele = a, in linkage disequilibrium with rs812824, respectively
  misc_feature [331]..[331]: n is a, t, c or g
gaaaaagtcagtttaaacagacattaaattacattaaaattagactttaaaacttaaaaggaaatagaatccttcaagagaaaataaaaaataaattaataaagaagagtaaggacataaagtaaacactaaagatcttgaggataataaccgtaaagataatagaacttaaataggaaattcagaaaatagaaagtgaaatggtaaaaaaaaagacactaaactctaacaagaatattaaccacaaggtcccgtaattaacacagagcgacaattggtgaagagacagttaattaaatgactctataaatcaaacttttagttacaaagntcaaaggttactagaaaactcccacggacacatgacacgaacttaaaattcttcacgatcaccattaggagttactttgtcacaaccctccaaccaggattaccctccattaaaccggtactctcgagacggaaatacttacttaattacagtaacaactccctcacccaagaaatactttcttactcaaaacaatagaggacgagagagaataagagagaaacgggaaaacgatacctcccttcctccgggagtattttacgaccagggaactagaacctgaagggtcggagatcttggtgtttagttatttaaagagaagtaatgttt

SEQ ID NO: 521 - DNA, 661 bp, Homo sapiens
  misc_feature [331]..[331]: Chromosome 3, SNP identification no. = rs812824
  misc_feature [331]..[331]: allele = g, in linkage disequilibrium with rs1402582, respectively
  misc_feature [331]..[331]: n is a, t, c or g
accagcattttatgagggcctccttccctccatagcaaaagggcaaagagagaataagagagagcaggagataacaaaactcattctttcataaagaacccactccctcaacaatgacattaattcattcataaaggcagagctctcatggccaaattacctcccattaggaccaacctcccaacactgtttcattgaggattaccactagcacttcttaaaattcaagcacagtacacaggcaccctcaaaagatcattggaaactggaaacattgattttcaaactaaatatctcagtaaattaattgacagagaagtggttaacagcnagacacaattaatgccctggaacaccaattataagaacaatctcaaatcacagaaaaaaaaatggtaaagtgaaagataaaagacttaaaggataaattcaagataatagaaatgccaataataggagttctagaaatcacaaatgaaatacaggaatgagaagaaataattaaataaaaaataaaagagaacttcctaagataaaggaaaattcaaaatttcagattaaaattacattaaattacagacaaatttgactgaaaaagatattcccaagcatatcctcttaaaactgctgaattccaaggataacaaatatattataagtt

SEQ ID NO: 522 - DNA, 661 bp, Homo sapiens
  misc_feature [331]..[331]: Chromosome 3, SNP identification no. = rs2936727
  misc_feature [331]..[331]: allele = g, g, in linkage disequilibrium with rs1402582, rs812824, respectively
  misc_feature [331]..[331]: n is a, t, c or g
tcacaaatgaaatacaggaatgagaagaaataattaaataaaaaataaaagagaacttcctaagataaaggaaaattcaaaatttcagattaaaattacattaaattacagacaaatttgactgaaaaagatattcccaagcatatcctcttaaaactgctgaattccaaggataacaaatatattataagtttctaacaggaaaattaattatctactaagaagtagtataaaactccttatcaaccacattggaaactagatgttggtgtactatctgaaaaactactgagaggaaagaattgcaacccaagaattctgtatccaaccntgatattatttaactgtcagaaggaaaaaataataatttgtagatatgcatgtcattcatatttcaccagaataaaatgctcaagaaagcactataataaaaaacaaacgaatcataacagaaaactcaatatctaacataatgaagaggagaggaaacaatgatgaatataaagctttgcagcccatgtgtgtgtgagagagagagagacagagacagagatggagacagagacagacacagagaaaacaataaatggatactgataaactatgggaatgaatgatgtaggcactaaataaggattattaaaatagaaggaataaacat

SEQ ID NO: 523 - DNA, 661 bp, Homo sapiens
  misc_feature [331]..[331]: Chromosome 3, SNP identification no. = rs1521289
  misc_feature [331]..[331]: allele = g, g, in linkage disequilibrium with rs1402582, rs812824, respectively
  misc_feature [331]..[331]: n is a, t, c or g
ttgccactgttgtttttccttcatttctgaagattctttcatcctgaaaaaaactttcgtagacatttctgagaaagcagatctacccatgatgattctgttagcttgccttcatctaagaaaagcatcttcattttatcttcattcctgatggatattttcactggacatagaatttgaggttgacaattcatttctttcagtatttaaagttttcgtttcattctcttctgtccttcaaggtttttgatgagcaatctataatcattctaattattgcctccctgtatgtaacatgtaatttttctctagctgcttccaagacttgctnctttattttttcttacatcactttgactatgctgtatctgggtgcagctctctgagtttgtcttgtttaggtttcactgagcttcctgaatgtaaatgtatgggcttttcccctccagatttggaaagttttgctgttatttcttaaaatgtgttttctctcacaatctctttttcttctaattctagaacttccataaaatttatgttagagcttttaatattgctccacaggtctcaaaggctctgttcatttttttcaatcttttatttttttgttcctcagattggacaatttctattgatctatcttcaaattcacttatttatt

SEQ ID NO: 524 - DNA, 661 bp, Homo sapiens
  misc_feature [331]..[331]: Chromosome 3, SNP identification no. = rs2684320
  misc_feature [331]..[331]: allele = t, t, in linkage disequilibrium with rs1402582, rs812824, respectively
  misc_feature [331]..[331]: n is a, t, c or g
ccataaaaccttcatcgattgaacaaaaactaaaatgtccgaatatccgtctactctgaaacctgaacctgaaaactcaattacgaccttaccccccatgacaacccttcggtactgacacaaaactgtatactcttcctgtactctaaaacctcttaggtccccttcttactataccaaaccgagacacaggggtgagtttggagtagagctccacagtaggtgtgtataactctctccctactgatctagtacccccgtcaaagggagtacgacaagagaactatcacccactcaagagtattctagactacaaaattttcatacaccntcaaggaagaaagagagaggagacgacggtacattctgcccggaacgaagaggaagtggaagtcagtactgacattcaaaagactccgtaggggtcggaacaccttgacacttagttaatttggaaaaaacaaatatttaatgggtcagagtccatcaagaaatatcgtcacacttttacctgattatctttgtacgaacttcatttactttttttacactcgagagacttctctttatttttaatattcttattttacttttaaaatcttgatttttacgttatacatttgatctttttatatgacctattcgtattatcgtaccaccc

SEQ ID NO: 525 - DNA, 661 bp, Homo sapiens
  misc_feature [331]..[331]: Chromosome 3, SNP identification no. = rs2649882
  misc_feature [331]..[331]: allele = c, c, in linkage disequilibrium with rs1402582, rs812824, respectively
  misc_feature [331]..[331]: n is a, t, c or g
agacgtattcttattcggacccccgggctactcgttcccagaaacctaacgaagcgatgagctgaatccgaggatcggttttctaagaatctgagtccccatccttcctaggacctcctatcccggagttctttcagaagagactcctgtaatcctgggtcctccgtacccagtcttttccgtcccttacgtacgtacccgtcgacgtctcatctccgaagagcgacacggtattagagctggaccagtcacggtcctcaagtcctgatgtcaaaaggtgaagatcggtcgggaaccgaaaagggtcctttccatctctttccaccttaancaagatccgtttgattatgagagtcggacctcccggtccccaacaatccctcgggaaagggtctttcggagtatggacacagaattcaggccgtcggtgtgaacagtgaagatttaccggctgtccacggaccacaaaaggaggttaaagatcgttcttctatcttttcttatcgttcgttttccccagactacaatgagtgacgaaacctctttaggacctgctcgggggtctttactctgttcttcagaagaggactaacttctaaaagaagagttagtttcccaagcaccagagtacccgaagttctttacttcgacacctggtgtc

SEQ ID NO: 526 - DNA, 661 bp, Homo sapiens
  misc_feature [331]..[331]: Chromosome 3, SNP identification no. = rs4686769
  misc_feature [331]..[331]: allele = a, in linkage disequilibrium with rs9830734, respectively
  misc_feature [331]..[331]: n is a, t, c or g
tggctttggacaaatttatgatgtttccactattatagcatcatacagaatcatttcactgccctaaaagttctctgtgctccaacaagttccctttttaaaaaaggaaaagaggccagtttattttgtgattgtgagcaaaaaagaaatgacaaaggcatccatctcctattctctgccttttgctctcaggaacagacatttttttccttcagaagagatgtggcttattctagatgcaggggtaatagtgatgtctgggtcgaggtctgcatccttcactcttggggagagctggaggcaatagagccggtgtaaggacaccatccanctgtggcagccctcagtggcgccctcttctagctcctgtgcaccccgcaggccagccctcactgcttcccaaggctctgagagctcacatgcaaccttttttctcattggcttaatttctcttaagaccacttcacaaaagctccattgtaatcactatctgctcaactgctttctcttacttacaagtttagtaaacacaaacattcttctgtctaggtcttactgacctgtagaaagttaactgatgaatggtacattttaagtcaaaacatactctctgaaccccaaacatagtagagcttttggtactctttccaaaaagaagaaa

SEQ ID NO: 527 - DNA, 661 bp, Homo sapiens
  misc_feature [331]..[331]: Chromosome 3, SNP identification no. = rs2377115
  misc_feature [331]..[331]: allele = c, in linkage disequilibrium with rs9830734, respectively
  misc_feature [331]..[331]: n is a, t, c or g
atgtttccactattatagcatcatacagaatcatttcactgccctaaaagttctctgtgctccaacaagttccctttttaaaaaaggaaaagaggccagtttattttgtgattgtgagcaaaaaagaaatgacaaaggcatccatctcctattctctgccttttgctctcaggaacagacatttttttccttcagaagagatgtggcttattctagatgcaggggtaatagtgatgtctgggtcgaggtctgcatccttcactcttggggagagctggaggcaatagagccggtgtaaggacaccatccaactgtggcagccctcagtggngccctcttctagctcctgtgcaccccgcaggccagccctcactgcttcccaaggctctgagagctcacatgcaaccttttttctcattggcttaatttctcttaagaccacttcacaaaagctccattgtaatcactatctgctcaactgctttctcttacttacaagtttagtaaacacaaacattcttctgtctaggtcttactgacctgtagaaagttaactgatgaatggtacattttaagtcaaaacatactctctgaaccccaaacatagtagagcttttggtactctttccaaaaagaagaaaatcattacactattctatat

SEQ ID NO: 528 - DNA, 661 bp, Homo sapiens
  misc_feature [331]..[331]: Chromosome 3, SNP identification no. = rs725656
  misc_feature [331]..[331]: allele = c, in linkage disequilibrium with rs9830734, respectively
  misc_feature [331]..[331]: n is a, t, c or g
caaaacacaaacgtatatatgtatgtgtatatacatacgttgtaatattttttaatattcgattgagatctatagacactcttagaaaaggggaatgtttcctagacttgctataggttcaaactctttgtcactatgaccttaaagaatttcaaagtaaacatgaatagatttgtgtccataactctaaaaaaacgttccgttttaaacgtagtcgaatatataaccttaaaaaggtatatcttatcacattactaaaagaagaaaaacctttctcatggttttcgagatgatacaaaccccaagtctctcatacaaaactgaattttanatggtaagtagtcaattgaaagatgtccagtcattctggatctgtcttcttacaaacacaaatgatttgaacattcattctctttcgtcaactcgtctatcactaatgttacctcgaaaacacttcaccagaattctctttaattcggttactcttttttccaacgtacactcgagagtctcggaacccttcgtcactcccgaccggacgccccacgtgtcctcgatcttctcccgcggtgactcccgacggtgtcaacctaccacaggaatgtggccgagataacggaggtcgagaggggttctcacttcctacgtctggagctgggtc

SEQ ID NO: 529 - DNA, 661 bp, Homo sapiens
  misc_feature [331]..[331]: Chromosome 3, SNP identification no. = rs7640976
  misc_feature [331]..[331]: allele = c, in linkage disequilibrium with rs9830734, respectively
  misc_feature [331]..[331]: n is a, t, c or g
tcaacttcccttctgggctggctgcaagtaagttcactttcttaaaggaggagctttctcctctcacctcaaggactgttatttatttgtctgcgctactctttcgacgtttccattctcttggtcctcaagatgtgaatcacccattttttccgtaggggggaagacggcgtatctctggccctttaaataggggcgtggtgaagaggcgcggaccgcccaggagggggagcagtgcgaggaggaaagcggaagcgctgcccgcagtggtaggtagtgcgcgtgcgtgaggctagagcagtgggtgcggtcacgtgggccggcggtccanggccggaatggcagcaagctcaggtaacgagtttccagagagcgggcccgtggaaggagacaggattgaggggccgtattcagggtaggaggagagcgcgcgacaggtctctgagcctcggcgtctcctccccgcgcgacagcggcgggacctcggggagcgaacagagcagcccctgacgggctaaccggacccgagccacgggccgggcggggttgattctcgagtggaggggcgtgtcgtacgttggcccggaactgggtcgggcaatttccacttactggttccaaatgaatgtgaaaattcaaatgggcttaagtaaaaagggat

SEQ ID NO: 530 - DNA, 661 bp, Homo sapiens
  KIAA0804
  misc_feature [331]..[331]: Chromosome 3, SNP identification no. = rs13079793
  misc_feature [331]..[331]: allele = a, in linkage disequilibrium with rs9830734, respectively
  misc_feature [331]..[331]: n is a, t, c or g
aatatattttattaagtgaattgagatgcaaaatttatgtcacttttgaggtttgtattatgtgttgctaatggttaagttgtctctaccactgatattcaaatagcttgtcctctgacgctaaagaacatcttgcaaccttataataagcttcatcactcttctacatgaagaaaactaatcttttatagtttatcttatgaataccatttctaatgaaaagtttttcagagttttgaaatggtgttattcttttctgaattgggagatcaaaggctttctaaaggggctctgtgagaggacatggttggtgaagcacgcctgttttatntaccctgcatctgctgacaacccttcaactcagtcttcattttttaaaaacttgcttgagacttcccttggaggttttagcttctaatttgagaaagatcttgcaatgtataaatctatttcaaatccgcagttatgttttccaaaagataaagacccaaaagttccctgacagaaaggcccacgtataccaaagctccgagtgagttgggcctctgtctttattatttctttgcctatcctgtgagggttgtaggcagcactttataggatgcaaactactttctctgtcaattatgtcttttatttttcttgtatggcttttatttct

SEQ ID NO: 531 - DNA, 661 bp, Homo sapiens
  KIAA0804
  misc_feature [331]..[331]: Chromosome 3, SNP identification no. = rs10513799
  misc_feature [331]..[331]: allele = g, in linkage disequilibrium with rs9830734, respectively
  misc_feature [331]..[331]: n is a, t, c or g
agtggatcgaggtagtgagtagacattaatctctcaagtacattgattggaagtggtaaggcagaaggtagtgcagctgaaagagacggtgagacattgttctctgatgtttgtcactcagaatcaacttgggcaaagccaagttcctcatcctgctttatctgccatttgtctgctttctaatttcagtgagtagagtcaccttttacctggttgtagaagctggaaaccttgtactcttctgtgacttctcccttacctctcctcccatccgtactcctactcaaccccccatttcaatggtaaccagagacgtttgattttttctccntaatgtgttcatcattccctctgttgacttcttctgcagcttcttaggttgggatctcccgtttttccttgatagtgcaatagccctcttactggtccttaaagtcttcttgtctcgcctcatccattcttcatactgccccacctatctttttaaaacatggttcccatcatgtctttccacttcttaaaaatgtcagttgccttcccactgcctgctatatatagtatactaaatattcattaaatgagtactggttatgtgtcaggcattatactaggcactagaggtacaatgatgaacaagatagacatgggccctgctgccatc

SEQ ID NO: 532 - DNA, 661 bp, Homo sapiens
  KIAA0804
  misc_feature [331]..[331]: Chromosome 3, SNP identification no. = rs9830734
  misc_feature [331]..[331]: allele = a, g
  misc_feature [331]..[331]: n is a, t, c or g
taaatcatctgtaaaagcttgatttttaagaaatattctacagctaacagtaatctgcatactgctcctgcttcttcctgctacacgaaagaagttttggggtgacttctttgtagagagaaatagctgtctagaatttaatactagtaattctgtatggtttctttctggtcaataagaatgcatggaatagaggcgaaaagcagaaataagcacttgtgtgctctggagaaacccattaatgcctgactcatttcatagagtatttggattttgaatgtattgatttatcttcttccaatttagactgatgatgaagatgagtcttttnttcttgaggatcctacattgttaaacattgatactattgattctcactcctatgatacttcatctgtggcaagctcagatagtggtgacaggaccaacttaaaaaggtaggtattcatgtcaatcatacttgcttacagttgaagtattcaattgtttcaaatgtaaatattgtactttttaaagtacaatatggtctgttgaagccttgcatgggaagtagaagggatataatatcttgaaaattttggtaccattaaggaagaatgtaaaagggtaggtgctatgaccacagtctgaactctcggtaggaaaccataatgatagccag

SEQ ID NO: 533 - DNA, 661 bp, Homo sapiens
  KIAA0804
  misc_feature [331]..[331]: Chromosome 3, SNP identification no. = rs4432622
  misc_feature [331]..[331]: allele = t, in linkage disequilibrium with rs9830734, respectively
  misc_feature [331]..[331]: n is a, t, c or g
ttggtttaagttgttttgcttaaagtcagtttctaagaacttactgacaacattaagtgaggtcttactagagtttttgaccttcatctgctgtctcatttctctttccctgtctagatgcaaatcagtcatttattaactatgtattacatgcttcttaattgtcgagcattatgttaggcatgtttgacacacagacatatacactcaaagttggatagatgctgctatccagagcattgtgtgtagcagccttgctcattgcttttttctcctgtttccatgtactggagtaagtttaagtgagtgcccaggaagctctacagagttngttaaatagagtctgtagagtctgccttctgagagatgataataattgaccacgctgacaaggacagacatagaaaagaagatgtgtaagtgatacaaggagcctgtcctgggatttggaagctctgagtttgagatgtagttctgccacttaccaagtaccctttgtcaagtcagttaaactcttggaaatgtctgtttttaaaatctggaaaatcagaataacattgcctgttctatacatctctctaggtctgagaatcaagtagtgtaatatctgtatacgcaagctctttgctgctacagtactgtatcactacaaactcttagg

SEQ ID NO: 534 - DNA, 661 bp, Homo sapiens
  KIAA0804
  misc_feature [331]..[331]: Chromosome 3, SNP identification no. = rs11710551
  misc_feature [331]..[331]: allele = t, in linkage disequilibrium with rs9830734, respectively
  misc_feature [331]..[331]: n is a, t, c or g
agttattttctgttggttttgaatgatttggcttactattataaattttgtattatgacaaaagctttttaaaatgtaattgtaaaacctagtcttttcaaaggtaattgatttaaataagagttttattgtttggggaccagaagagtagaaacaaaattataattcccttgaaggaatttagaattgattgaaaaagactcttaaaacctatatagttgatatatagtcatagtagaaaatatagaaaatatagatgagcaaaaagttgaagatataccaaatcctgccatgtattaataatccctaacatttttgtatgtaatctttnagtctttttttctgtacctatatatgtgtatctatacaccctcaaatgggatcatgttaatttgtaaactgctttttattttaatgaatatctttccatgcagttatatattttgtctgtaacatcatttttaatggctatatagtattctattaaatggattcttcctaatttacttaatcatttcctactataagacatttaagttgtttgtaaacatatagtactgtgatgaacatcttcgttactacatttctgtgtccatgattacttttttaggacagatgttcctaaaggtggaattgcttggattaggagatgaacattaag

SEQ ID NO: 535 - DNA, 661 bp, Homo sapiens
  KIAA0804
  misc_feature [331]..[331]: Chromosome 3, SNP identification no. = rs16859344
  misc_feature [331]..[331]: allele = t, in linkage disequilibrium with rs9830734, respectively
  misc_feature [331]..[331]: n is a, t, c or g
acttaccttatacagagtcttaaaagttcaaatcttaataaagatgtttccccatcccagggttcttagttttcctctttttttttttggttattagtgtacttcagtagattatctttttgaaattgtttttgtttttatctaacttaaacatggatttacttactttgctctaatgagagtattatggattttttcccataacccatagctgagcataatcataaatactagaggcatcacttaatcaaatttagtatcattcccacagataactaaagcttgtcacttatattcttgaaattttttacctgccttttcttcgaacttntgaactgatttcttgcttttctttatctttcttgatcttttcttcatggattcaaaaggaaaaggtatagtaagtaattttagtttgcatgaatggtttcttttggtctttttaatgttggaagagaatgctaccaattatagtcaatgtcctcttacgaaatgcttattgaaaaaaacccagctaattgaaaaattagttaagtgggaaattgtgaaaaactgtaaatatatatataccttcaatgttttaactgaaaaatataatttttaactgaaagtatatacattttcatttttcctttgatcttttgatgtagtcccaaacctt

SEQ ID NO: 536 - DNA, 661 bp, Homo sapiens
  KIAA0804
  misc_feature [331]..[331]: Chromosome 3, SNP identification no. = rs2305240
  misc_feature [331]..[331]: allele = c, in linkage disequilibrium with rs9830734, respectively
  misc_feature [331]..[331]: n is a, t, c or g
ttggtattagattacggtcaaagtcttcttctttctttacgtttttagcaataggtccttgtgtcttagaaagatttttcgtcggaggtaataaatgtgctgacattccttcatgtaaaatatattgtagggaccaaccaaatgtttttaataaatgagtttatctgtgtacttgatcctatattttttaatgtctgagacccagtcagctattgttaatacattttaaaacttgttctgttttgagtctaagtcgttagagaccaatcgagatgtttgtataatgaagtattgtgcataaaaccagaaactagattctacattcaaaaanatttaagtagaacaaaattgtaacagaatacttaatttcctccaagtatagaatggacaggaaatcgtttcggtgtttcttcagaactcgttagtaacaactatgactcccgtctctatcgcggtatgactggaggttgtgatcacgatgggtctgtctcagcgtttcgaactaagactagatttctttcgtcaaaaatttcagttcacttcctttacgttctctcatttatgtagctcatgtccgtacgaaagtttctgaaccctccactgttcttagttttcgtcgtctattacttcagtgtaagtaaaaatttatataaataactcg

SEQ ID NO: 537 - DNA, 661 bp, Homo sapiens
  KIAA0804
  misc_feature [331]..[331]: Chromosome 3, SNP identification no. = rs11720538
  misc_feature [331]..[331]: allele = a, in linkage disequilibrium with rs9830734, respectively
  misc_feature [331]..[331]: n is a, t, c or g
acatgacttattattctgagttttctaagttaggtagtgataactgaagtatatgctgtggaagaagatcaaggaggtagcacgttttgggaagagttacatatgaaaagttaaaatgttttagatatagtggacttacttttcagctattcagaagacatattcagataagtttatttctcaaagataccaagtattttttagagtctttattctttaaaactgggcaggtgtaaatgtaaccaaaggatctcatttacttagtaatagcaagttacaaaaagttattgtaagaacccaaatagagaactttagggtttttaatcaatcntagtttgtatttttcttttatcgtgatgaaaggtggttttgctttttgaaagcctctgtttttttaaagatattggaccattattactctaaataaaggtaagtttgtaagtttagagtgatgagcactgaatctagtttaggttatttcaaaagctattaaatgtgtatattgtagtttttcaaaattgtataattttttcctccttaatacttgactgtttaaaaatgtacaagaaaataaattccttctctgtttagtttacagatgatccaactcttgcaatttgcaacgacagcggaggctctgtttttgaattgacatttaagt

SEQ ID NO: 538 - DNA, 661 bp, Homo sapiens
  KIAA0804
  misc_feature [331]..[331]: Chromosome 3, SNP identification no. = rs6443999
  misc_feature [331]..[331]: allele = c, in linkage disequilibrium with rs9830734, respectively
  misc_feature [331]..[331]: n is a, t, c or g
atacaaagaaatgcacagatcttgagtgtacatttgctgaactttgacaaatgcttaacacttttgtaactcaaatgcctatcaagatgtagaacattaccatcaacccagaaagttccctcatgatacctcccagttagttcttgctttactgagaaattggggaaagtttttatcaaggaacactagtcagatgctgtttttaaccatagttttctctttgtccccttgtttattaactgtgatgattttttttttccatctccctacttagatggatccttccagtgtgccactgctggcctggcactttgtagcagtacaaaattangtgaatcccatgcttgccttctgcagaggagatgttgttcattttctattggtaagtcctaatatgaccattagaaagcctcttacaattttttttattcatcagcaattaataatgtgtcagagaaatttgtgttactatcctaagtctttggagagagagtgacctatttaatttttatctaaggctttaatgattagcatcggaaaatggtgatcactctcagctacataacttctcatggtttatttctcagcttcatttctttgactgacaaataattaatggtatatgtaaatgtataaagatatgaatgtgaatatgtgttaa

SEQ ID NO: 539 - DNA, 661 bp, Homo sapiens
  KIAA0804
  misc_feature [331]..[331]: Chromosome 3, SNP identification no. = rs16859357
  misc_feature [331]..[331]: allele = a, in linkage disequilibrium with rs9830734, respectively
  misc_feature [331]..[331]: n is a, t, c or g
atacaacatttgagagtcctatctttactttcaactcaacacattgaaatattccttaatcattttcttcctaaacagtatctcttcaaatatttcttgattctaaaatgtaaagtcagaaatgggatgtttcattcatgtccttcagtctctagatccaatatgatgagaaggcttgtttttccttgaaagtatcatcccttaactctcactgcaaccaaccctctttgtataaacaccttacatgtgctttattatgagagaaaaacctttaatgtttctcctcccttctgtgtgtattctttttgctacttcaagactgatcttcctnaaatgtcactttaatcccgtctttatgactttaattacttaggaacctgtgatgactccattaccagtctaggccaatcattattaatctagatcaggggttagcaagctttttgtgtaaagggccacaaagtaaatattttagtatctgtggaccatatattctcgggaaactgagaaagagtaggtgactgcccttggtcacacgggtataatagtggaacttagatatatggctctagatcccatgttcattttaccaaaagatcttttcttaagggagaagtgatttagtgaagtgaagaggggtccacatgaagggcccacatta

SEQ ID NO: 540 - DNA, 661 bp, Homo sapiens
  KIAA0804
  misc_feature [331]..[331]: Chromosome 3, SNP identification no. = rs724273
  misc_feature [331]..[331]: allele = a, in linkage disequilibrium with rs9830734, respectively
  misc_feature [331]..[331]: n is a, t, c or g
cgactacaactctttattttaaataaaaataaaaaattaaggtaaaaaggtgtttgaaaaacttcaagggaacacattgagaacgtcgggttttaaagggttttcctggaactcacagttagaaaataaatatacatatattcatgtgtgagatataggagtcagtaggaatattaaacgaagaaggggaagacgaggttccattgtcttgtgacttctttatatttcgtgttctatgtgggctggtggactttaagtaccgtaagttaagttggacccgaaagaacgtgtgaggggtatcatcatagtatctacagaaagggaaattcantggaagactagggtagtgaatgtcaccactggagtggactatagaattgtttttagactttggtgaattacacccgggaagtacacctggggagaagtgaagtgatttagtgaagagggaattcttttctagaaaaccattttacttgtaccctagatctcggtatatagattcaaggtgataatatgggcacactggttcccgtcagtggatgagaaagagtcaaagggctcttatataccaggtgtctatgattttataaatgaaacaccgggaaatgtgtttttcgaacgattggggactagatctaattattactaaccggatctg

SEQ ID NO: 541 - DNA, 661 bp, Homo sapiens
  KIAA0804
  misc_feature [331]..[331]: Chromosome 3, SNP identification no. = rs6809079
  misc_feature [331]..[331]: allele = a, in linkage disequilibrium with rs9830734, respectively
  misc_feature [331]..[331]: n is a, t, c or g
taaggatgactgaggatatagagtgtgtacttatatacatataaataaaagattgacactcaaggtccttttgggaaattttgggctgcaagagttacacaagggaacttcaaaaagtttgtggaaaaatggaattaaaaaataaaaataaattttatttctcaacatcagcttcatcttgttcaagatactttttaaagtgatgataccagccatatagtccatcctaaagaactgaaggtcttgggaatttaatcatgccaatgcagtctttttcacattattaactaaagagaaatgggtgccctttatagactttttctagattagnagacgaaagtcacaaggagccaaatcagtactgtatggtggatcgaattgctctcaaaattggccttgtgtgatgagagcaatgagcaggaacatggttgtggtggaggactctctggtgaagctttcctgggcatttgtctgccaaagctttggctaactttctcaaaacacactcataataagcagatattattgttctttgttcctccagaaagtcaacaagcaaaatgccttgagcatcccaaaaaactattgccatgacctttgctcttgcctggtctgcatttgctttgactagaccacatctgcctcttcatagcctttgctt

SEQ ID NO: 542 - DNA, 661 bp, Homo sapiens
  KIAA0804
  misc_feature [331]..[331]: Chromosome 3, SNP identification no. = rs7340698
  misc_feature [331]..[331]: allele = a, in linkage disequilibrium with rs9830734, respectively
  misc_feature [331]..[331]: n is a, t, c or g
aaataatggaacaaataattttttttctattttcataatcatttgtgtaattatcagtatttttggcttatctacagggaatgggataatgggtaaatgtgatactctaggtggagtataattaaatatctaaaaaagtccctcaaacagtagctggtttttaggttgtttttatttcatcatcaggtaaagagagatgaatctggagcaatacatgttactaagcaaaagcatcttcacctatactatgacctcatcaactttaccgtgagtattattcaaattaaatatccccatttagttcatgtaattgttctgaatctatgatatnttaaagctaccaggatttctgccaagaattattacctttaagatcatatgaaatatggacagtccggcaccgaggctcgtgcctgtagtcccagctacttgggaggccgagctgggatagcttaagcccaggagttcgaggctgtagtgctcagtgatcgctcctgtgactagtcactgcactccagcctgggcaacatagtgagaccctgtctcttaaaaaaaaaaaagtatatgtgtgtgtgtatatatatacgtatatatatgtatgtatacgtatatatgtatatatatgtatatatgtgtgtatatatatgtatatgtatgtata

SEQ ID NO: 543 - DNA, 661 bp, Homo sapiens
  KIAA0804
  misc_feature [331]..[331]: Chromosome 3, SNP identification no. = rs3733165
  misc_feature [331]..[331]: allele = a, in linkage disequilibrium with rs9830734, respectively
  misc_feature [331]..[331]: n is a, t, c or g
ctcaatgtaatttaatcgagcagccaagctttcttcttgacccaaatgatgaagcgggtgtggtctcacttttgttttgttgtgtgcttgaattacagtggataaattcacgcacagttgtgctcttagacagcgtagagaagttgcatgtgattgatcggcaaacacaagaggaattggagacagtggagatctcagaagttcagctggtctacaatagcagccatttcaaatcactagccactggaggaaatgttagccaggcactggtaaggataatcacttatcttgctatcctagaaaatactttgataaacttggtattttgttntagttgttttagaaataggaactctggggagttacctttttctgtcttgaggtgtttctttacaagccactaggttgaagtgggtgtggatgtgcttataagtgtttgggaatacaagctaaaacaatcatttttcttcccttctattcagaaatgtgacttattttacttaataacaaagagttttaatttttatactaaaataatgacgtataatggaaaatttgtgagaaaaattgtaaaaatcaaaatatttttagaaagcttaatttggcagtaataagcctgatagatttaagggataaataactacagacaggtactctatga

SEQ ID NO: 544 - DNA, 661 bp, Homo sapiens
  KIAA0804
  misc_feature [331]..[331]: Chromosome 3, SNP identification no. = rs2377107
  misc_feature [331]..[331]: allele = t, in linkage disequilibrium with rs9830734, respectively
  misc_feature [331]..[331]: n is a, t, c or g
ggtgtgcacctgtagtcctagctacttgggaggcgaggccagaggatcacttgagcctaggagtttgaggctacagtgagctatgattgcggcactgcactccagcctgggcaacagagtgagacctgtatctaaaaaaacagtcaggttataattccctgtgtcatcttgaatacttttaaaattccttcttaatcaccttttcttttttcccttgctcactcttttatgaagataataaagtacatagccaaaagacagcaggaaggaggaggaagaaaacctgggaatctggattatttctgaaccaagtaatagcccacagaaaatngacatttgttagtttttataaacttactagtaattatgagaactagtgtatgtgcaaatgtttgtgttgcccagaactagcagagaggattaatgttttaatgttattattaattagcatcaatataattgatgctaatatttaatattgaccttctgttcctactctagactgggctgaattaattgactataggattccctcccttttgttgtgtaaatgcattggtaaaaattatattccaaattagtataaacatttgtggaaaacctggatagaaattggttactccttagactccgaatgatttgctcatctgtgctctttagg

SEQ ID NO: 545 - DNA, 661 bp, Homo sapiens
  KIAA0804
  misc_feature [331]..[331]: Chromosome 3, SNP identification no. = rs7619460
  misc_feature [331]..[331]: allele = g, in linkage disequilibrium with rs9830734, respectively
  misc_feature [331]..[331]: n is a, t, c or g
aggaaggaggaggaagaaaacctgggaatctggattatttctgaaccaagtaatagcccacagaaaattgacatttgttagtttttataaacttactagtaattatgagaactagtgtatgtgcaaatgtttgtgttgcccagaactagcagagaggattaatgttttaatgttattattaattagcatcaatataattgatgctaatatttaatattgaccttctgttcctactctagactgggctgaattaattgactataggattccctcccttttgttgtgtaaatgcattggtaaaaattatattccaaattagtataaacatttntggaaaacctggatagaaattggttactccttagactccgaatgatttgctcatctgtgctctttagggaaacacctacagcgaggattactgaagaacttgaatgtttcatttcctgagcagtatagatgccactgaggtctagaacatggagatatttcttaagaaagattagcaaattagtactagccctgagactggaagaaatgaggctagagttttaaaaagttggtaaataaagccactaaaattttcagttaaattttaataacaaattctaattatgtattatttaggagagccacatacatattgaaaaactttagagat

SEQ ID NO: 546 - DNA, 661 bp, Homo sapiens
  KIAA0804
  misc_feature [331]..[331]: Chromosome 3, SNP identification no. = rs9757458
  misc_feature [331]..[331]: allele = a, in linkage disequilibrium with rs9830734, respectively
  misc_feature [331]..[331]: n is a, t, c or g
tgcttattaaatttatcagtagagaaggagaaataagcctagataaagttataaaaataaataacttaggaagaagacatatggtagaaagaaagcatttgggaacaaaactgtttggaaacaatactttatatataagtacttgtgtataccaatgcagtatagatagaaaacttaatatttgtaacaagaatatacctatcaccaagaggttgtaggaactctggcctttggaaggtatactttgttgaaaaaaatcatctagtagaaaaagctaggaggggtgaatggaatgagtgtgtatgtgtgtgtggagaatatagaaaccacngtgttgggggaaaacgtggtagagagcttctttctaaaagatgaaaggaacaaaggtgacgttctgatggagaaatagtaaagaatctcagatacgggaactgtagatggtggtttctgatgcattcctgtagatggtggtttctgatgctgactgcagaacgtacagagatgcattactactaacagatgttagtagtaatgtgctctgtaaccatctagcttcctgttagaagtctcattctgttggtaagagtatctgataaaatttttgatttttcagtgattagtctcataggaggtgaaggaaacaatggaggggactatttct

SEQ ID NO: 547 - DNA, 661 bp, Homo sapiens
  KIAA0804
  misc_feature [331]..[331]: Chromosome 3, SNP identification no. = rs7628188
  misc_feature [331]..[331]: allele = c, in linkage disequilibrium with rs9830734, respectively
  misc_feature [331]..[331]: n is a, t, c or g
gtacagagatgcattactactaacagatgttagtagtaatgtgctctgtaaccatctagcttcctgttagaagtctcattctgttggtaagagtatctgataaaatttttgatttttcagtgattagtctcataggaggtgaaggaaacaatggaggggactatttctctggatttaatttttactaatgattggggaagtagaagagatagacccttgagagaaaaattatcactttattttaacaatcataataatgatgaaaaatatacatagcatgagtcctctatttcagaaagcaaatatctcagaaaaaaatatgggcacaatnacatggctacaggctccaaaaaaagaatgggttcacaaggaacaggaaattctaaaatttcaaccattcaaggagaaagtaatgttgaaagaaggttctatctgcaaatcacagaacatctataaatatggagaaaggcatataactaaagatacataccagaagtatcatgaacttgtaagactgtcagaaaggagaatgatatggtccagactgtgcctaccacaatgctgtggagtacaaaatagggatttttaacaaagatttactgagcacatacgatgtgccagatactatgtaaagtatgtgacatgtatttttattctcaaa

SEQ ID NO: 548 - DNA, 661 bp, Homo sapiens
  KIAA0804
  misc_feature [331]..[331]: Chromosome 3, SNP identification no. = rs7638317
  misc_feature [331]..[331]: allele = g, in linkage disequilibrium with rs9830734, respectively
  misc_feature [331]..[331]: n is a, t, c or g
catgaagacttcttgaaatagtctgtccatttttggcttccctgatatcatgcattccagttttttccctacctctctgactgcttattgattctctttgtttattcttcttccttttctttacttaaccaagaaatgttaggattcttcacaatacccttctatttttatatcaatgtttgtcaagatgtctgtgtaccatttacttcaaaatcatttgaagatatttgttaaaaatgcttttttttttttaatttcccaggcctactgaatcagactctctgggattggtgaccaggatttgtagtcagctttcaagatgtcccttaancacattaaagtttacaaatcactgctttacattcttccctaggtgatataggcacatggctatctaaccagtgttaacaacctagattgctcttctgaattctgaggtctatagagtaagttgcccatttacatttctgcttggatgttttgtaggtacctcagactctgtttcctcacaaagccttttctgaggattcctgtgttagtgagtggatccaccatgcacctaatgcaaattgggtgattcttgtcttttacttgttcctggctattctgcctcctgacagtttctctcatctgtttccaccatgctgttaattctgccact

SEQ ID NO: 549 - DNA, 661 bp, Homo sapiens
  KIAA0804
  misc_feature [331]..[331]: Chromosome 3, SNP identification no. = rs11717139
  misc_feature [331]..[331]: allele = a, in linkage disequilibrium with rs9830734, respectively
  misc_feature [331]..[331]: n is a, t, c or g
aattttgaatcattttcacacagtcaagttttccttatctgatagtcttttagaatataaattaagagaattagtaccatcgctccaaaaagcaaaggaatctgcatctgttatttcttttcaaatcatcccatgaaatagggaaaaccagagattatgtcttcacttcacagatggtaagatagtcacaatgcaataaaatgatttattcagtcactcaaaccattgacaggctcaaatttaggttatctgtcagctcagttttttatttgtatatccacattgccttctttaatacatcttaaatatacatgaatatccgacaagagangcagtcttttttggcccattatagcccatacattgaagaagagattagagaaatagttacttgttttcttttttttaattttggagaccccaaattcagtgatttcttgcatcctgcaagcttttgagactgagtagaatattcttaatattcttaaagcaggtattgctcacagtgtctatctcgaaagcccttaatctgtcagcatcctgtagagaggcatatgtagaccaggtctggctgtatgaactgagggctttgctgcaagagaaggacttgttctttcccattctgctttctttcagggctctcatgagaggagccttccaa

SEQ ID NO: 550 - DNA, 661 bp, Homo sapiens
  KIAA0804
  misc_feature [331]..[331]: Chromosome 3, SNP identification no. = rs11714752
  misc_feature [331]..[331]: allele = t, in linkage disequilibrium with rs9830734, respectively
  misc_feature [331]..[331]: n is a, t, c or g
cagtttgattaacaattttaccggttgaagaatatctgggttgtttccagtttggggctgttaaaaataaagtggctctaaacatttctgtatatgttgctgtgtgaacatgtcttcttttctctaggagaaatgtccaggtttacaattgttggatcatatgatagttgaatgtttaattttaaaagaaactgccaaatagttttccagaatgccagtaccatttcgcattcccctagcagtgtgtaagtgatccagtttctagtctacatccagcatttgatgaagtcactgttttattttagctattctggtaggtgcataatggtanctcattgtggctttaatttgcatttccctaatgactaatgatgttaaacatcttttcatgtgtttatttgccacatgtatatcttcttttgtgaaatgtttctgcatgggttttgcctctcttctaactggattgtttctcatcatactgttgaatttttagggttttaatatattcaaggcactagtccgttattggacttggttctcccagtttgtagctttcttttcatccttcttaacaggatcttttgcaaaccaaaggttttaattgtgatgaaatccaatttatcagcttttccttgtatgattgtgcttttgaaatcaagtc

SEQ ID NO: 551 - DNA, 661 bp, Homo sapiens
  KIAA0804
  misc_feature [331]..[331]: Chromosome 3, SNP identification no. = rs9881074
  misc_feature [331]..[331]: allele = a, in linkage disequilibrium with rs9830734, respectively
  misc_feature [331]..[331]: n is a, t, c or g
ggtaatactaacttaacaaaatgaattgagaaatgtttgctccttttctgttttgtggaagggattgtataggatttgttttcatactttttaaatgtttggtacaattctctagtgaaaccatctaaacatggagatttatttttgggggattttaagttatgaattcaatttccttaataactataggggtattcaaatgagctgtttcatgttaagtgagttttgatagttgtgttttttgagaaattggtgcacttcatgtaaattgtcaaatttatgtgtgtagaattttcatagtattcccttattatccttttgatgttgtcantgtctataatgatatcctctgcttcattcctgatgttttctcttattctttgtcagtcttgctagaagtttgtcagttctaatcaggaagataaaacaccttaactaaaaacaccaattatatccaaattgctaaacgcaataaatatttttcagatcttgttcattctcaattctgtattaaatagcaatgattagttcttccttcttgaaagcctatatcctgtagatatctgtgactgtgtgcccttctgattttaaaccccagtgacttttcctgaatcagtttgtttctatcctctgaccatttcataaatattggtcttcctca

SEQ ID NO: 552 - DNA, 661 bp, Homo sapiens
  KIAA0804
  misc_feature [331]..[331]: Chromosome 3, SNP identification no. = rs1000270
  misc_feature [331]..[331]: allele = t, in linkage disequilibrium with rs9830734, respectively
  misc_feature [331]..[331]: n is a, t, c or g
aaaaattttgagatggtaaattcaccaatctgacttgataaattaatttgtatcttaagaacatagattatttagaaatcagtaacgtacaaactttatcttcccttcactttctaccggatctacgtttgttaatttcaactagtttgccgaataagttagaaaggaagattcaagtccgggtatatatcttcttagaattgtaagactactttttcttttcggtcataccactcttcgtttgttcgtgttgtgtctggatcttgttttctccctcgcaaactgggttacggatcaaagtgtcggggctggaaagaatgtagagatcctnacgacgggagggcgaaaaagaggataatcttatcttgggtttctcatcttaatccctttctctgttcctccctttctttctgttattcttgtgtgtacgaccttgaagagggttcgtctccgtcctagatcatgttagatcagaagccacaatcttttgtcttaactctctttcccttcggtaggtatgcgagaaacatgataccaggtcccttttacaggtaccggaactggattctcacacatacattctcgtcctcctccttctttcttttctccatacttttcgtggtccttctcgacttgactccttcctaagagaaggagaacc

SEQ ID NO: 553 - DNA, 661 bp, Homo sapiens
  KIAA0804
  misc_feature [331]..[331]: Chromosome 3, SNP identification no. = rs6762984
  misc_feature [331]..[331]: allele = g, in linkage disequilibrium with rs9830734, respectively
  misc_feature [331]..[331]: n is a, t, c or g
atcaatgtactattgagtaatgctatttgtagatatattctgctggggaaggctcctgaaaatggtaggaggccattatttgttaattgatcatttttcacttttactgactcagaattttatagcattcattctaattttttattctgcttaccaagagaatctaaaaaacatttggacttacttttagaagaaccaaaccccatatctgttttcttatttgttttcagtttgatggcagaatagtggagaatgagttgtagacacatgtagtgccctcctagcccaatgctttattatagtgtccctcaaaaaaagcaggcctctgccnaaggcatccagtcaaccatttagctaatttattgctatccaaaactatcttcagtattaagaagtcagcattctatgataggtaggcttctttaagcacattcagtttggtagggcgagtacccctctaattcataacccttcagttttggttgcacctctcttctttcggttagtttctaaagttagtcccccacccttctacctctggttttgggggtttggccctgattgtctgttatctcaaggatttttttttgtcttgaacacctctcggctgctccttcattaaggttcagtagttccctgaaaaagactcatcagctgcctt

SEQ ID NO: 554 - DNA, 661 bp, Homo sapiens
  KIAA0804
  misc_feature [331]..[331]: Chromosome 3, SNP identification no. = rs4324453
  misc_feature [331]..[331]: allele = c, in linkage disequilibrium with rs9830734, respectively
  misc_feature [331]..[331]: n is a, t, c or g
ttggtcttaaagtcactttgctttccccttttctgcagaaaaggcagctgagattttgataaggattgctttgaatctgtacatcaattttattactgtcttaatattaccaaatctttcagttcatgaacacagcacatcttttcattttatttaggtcttcattaatttttttcaatgatgttttgcagtttttaatgtataggtcatatactccttttcctcctcctaagtattttattcaccttgatgctgttataaatgaaattgtttccttaattttattttcaggatttgctggtgtgaaatagattgacttttgtatattgancttgtatcctacgtccttgctgtattcatttattagtgctaatttttaacttcttagaactttttaaggaaaatatagatgtcttctgcaaataaaaataattataattttttctttctaatatagatgcctttctttttattccctaattgggctgactacacccactaatacagtgttgaacagaagtggcaagaatggacgtctttttgttttcctgatattagggggaaagcactcaatatttcatcattaaatttgatgtagatggtcttagccatttgatgaagttttctttacccagtttgagtgtttctaacatgaaagact

SEQ ID NO: 555 - DNA, 661 bp, Homo sapiens
  KIAA0804
  misc_feature [331]..[331]: Chromosome 3, SNP identification no. = rs7618180
  misc_feature [331]..[331]: allele = g, in linkage disequilibrium with rs9830734, respectively
  misc_feature [331]..[331]: n is a, t, c or g
ttagccttctctttggctgccggctgaataaaagactcttaattcgtctcaaagtgtggcgtttttctaactcgctcaggtacaacagtaaagtaaacatagaatagaggaagaagtcaaatatgcatttgtcttgggatgggctgaggaataatttatagtcttatctttgtccagtgcctgtgaagatcagctattaatttacattgtcagggtgagggaggccagctggggagacatggccttctatcttgcagcaatctgtttaggaaccaaaggtagccaggattttcgtttgtttgtttttgtttttgttttttacatgactcanttccgaagcttaacttttccttttggcatagtgagtttgggattctgagactttatttttctttcactcgtgtttatctagttagccaataaacattaagttgttatgccatgcaggtggtgatcaccatgtgtcatacgagttgatgtgaatcaaatgacatttggaatggaagcaaaatgtagttattcatacatttggagcaattcatgtttacatgcactaacaacatcacagattttgagtatttgtgaaagattactgataaaggcatacacttgcttgcattatgtccagtattcatattaccaaaaatagaaactccagctc

SEQ ID NO: 556 - DNA, 661 bp, Homo sapiens
  KIAA0804
  misc_feature [331]..[331]: Chromosome 3, SNP identification no. = rs9821657
  misc_feature [331]..[331]: allele = a, in linkage disequilibrium with rs9830734, respectively
  misc_feature [331]..[331]: n is a, t, c or g
cagagaacaggctcgtatcacaagatggcagaatcttacattttttatgtaacttagaatagaaagggccctaaagatcatttagtttagttctgttactttaaacatttgggaacaatggccttttcagccctagagcacggtaggtggtaaaagtccatattacaaataagaagacagtatggttatgccttaacactaattaattggttctgatgtacagttcatcagctcattgcctgccctacaccttcccttggccccaagttagttaggccaacagtacatagatctctaccctcagatctattccttctacatctatcttagngtagcttatattgctcttgtgtctgtgacaagaatctaatggaaactcaaaagccaataaagtggtcttaacttcctgttatttgggaatatacttacctcaccttaaatgccaagttttatttttttgtttctacataaagattatttttctgaaaaggttttgagagaaaattgctgaagatacttctctttctattttagatgaacaagttgttatgggcaataagctccttgtatatattaggtaagattgttttatttattcatctgcatgtatgttctttctatatttttcctatatttttagagatactatgatctcttatct

SEQ ID NO: 557 - DNA, 661 bp, Homo sapiens
  KIAA0804
  misc_feature [331]..[331]: Chromosome 3, SNP identification no. = rs4686879
  misc_feature [331]..[331]: allele = c, in linkage disequilibrium with rs9830734, respectively
  misc_feature [331]..[331]: n is a, t, c or g
ggcttacacgtgggtcaggagctatcacctgttgcaggagagagcttacacactattactaaagtcaataattagagctgagaaagaatttaagagagaacttaaaatacagtagcaatttaaactgaattcagcctgcctttattttatccaaatgagaatcactgcttcagcaagatactttgtcaggtgagaaaataatcaacatttttttcccaacttgcaggtttttgaatttctaattcgcctgcattcagcagaggcttctcctgaggaagaaatctatccttacattcggactttgctacattttgacacaagagaatttctnaatgtattggcactggtaagagacagtattattttaaggtgttttcaaagaagacagagcaataattttttggcggggtgtggtggctcacccctgtaatcccaacactttggccgaggcaggcagatcatctgaggtcaggagttccagaccagcctggtcaacatggcaaaaccccatctctactaaaaatacaaaacttagccaggcatggtggcaggtgcctgtaatcccagctacttgggaggctgaggcaggagaattgcttgagcctgggagccggagggtgcagtgagctgagattgtgcctttgcactccagcgtgggcta

SEQ ID NO: 558 - DNA, 661 bp, Homo sapiens
  KIAA0804
  misc_feature [331]..[331]: Chromosome 3, SNP identification no. = rs7611263
  misc_feature [331]..[331]: allele = t, in linkage disequilibrium with rs9830734, respectively
  misc_feature [331]..[331]: n is a, t, c or g
ctattaaattattttaaaaaggtaagtactcatgagaaggttattatcatttgaattggtttaatttgaaaatctgacatcagaagtagtaactttaattgcatagaaagaagagagggagaaacttagaagtcagatctagttggtttaggaaattttaaatgtccagaggggaacataagggtagttggtgactggcacataggaaaaaaagaaacaagaagtgatggaggaggaggtttagaaagagtgttagagaaaacaaagaacttaatgtaatttttatttctttaagggctgtggtagcaccgaaacacatttggaattatgntgatgtctgaattatgacactgggatttatagtaaggcttcaaaacagtctctgatttggttgacaaatatttgagtgcatggtatatcccatgtattatcttcattaggggatgcagccttggcaacaagatataaactgcttttgtggaggaagaggatccagacttgtagataaataattatagcacagtgtaatatatgccttaggggaagtacaggatgctataggaacacttaatgaggggcacctactggaacgttagggaatgtttctgagataaaatggtgtctacactgagtctcaaaacattaatagaagttagtcagg

SEQ ID NO: 559 - DNA, 661 bp, Homo sapiens
  KIAA0804
  misc_feature [331]..[331]: Chromosome 3, SNP identification no. = rs9825856
  misc_feature [331]..[331]: allele = a, in linkage disequilibrium with rs9830734, respectively
  misc_feature [331]..[331]: n is a, t, c or g
caggcccatttaaagaacagtaactactcttgtttgaacaggagtatgatgtagtcttgaaagttcatggctgtgaaattcctttttatttttagtctactgggacaatgcgtagttcattttcttgtttcaaggaaatagcaataaattagtgctacgtggatttaaacatttctcagaatcaaatgaactaagtgaaaaccataggaactatctttaagtctttcatcattcttattgttcagtaaaaattttcatttccattttttgatagtggacataatctcaatttcttcatatatactatatgtactaggttttttgtgacacnctgttacatatactgacaaacagaatctggtattgtaatttattttgatgcatgttatgttcaaagtattttggctgtgcttgatcagttacataaaataaaagttgctatagttggcagtgttttgagaatagtaagtaggcttgagaattttaaccttttttttaccataataatttttaaaaatgcctatctttggacatcatttttcttaattgtcatggaaattgtgaaagttatttttatgacagttaataaaatgtgtcttagttatttccaaataacagactgaatgatggctgaacatgtagtattttatccttctgttct

SEQ ID NO: 560 - DNA, 661 bp, Homo sapiens
  KIAA0804
  misc_feature [331]..[331]: Chromosome 3, SNP identification no. = rs9290804
  misc_feature [331]..[331]: allele = a, in linkage disequilibrium with rs9830734, respectively
  misc_feature [331]..[331]: n is a, t, c or g
gctcacgcctgtaatcccaacactttgggaggccgaggcgggcggatcacgaggtcaggagatcgagaccatcctggctaacacagtggaaccccgtctctactaaaaaaatacaaaaaatgagccgggcgtggtggcgggcacctgtagtcccagctactcgggaggctgaggcaggagaatcacttgaacccgggaggcagagcttgcagtgaactgagatcgcgccactgcactccagcctgggcgacagagtgagactctgtctcaataaataaataaataaataaataaatagttagcacacctgcacctgatgttacatgtactnggttaatcagttgggaaggtagcctacacctgtggtatttgttatgtctgggtgtgaatgagttggttatttgaaagggtagttattatttttattatgagagtattaatgtctagatgctgatatcaaataaaaaatactttttcttcggccaggtccttgaattcctttgtagtcctgacgatgactcccgacactctgaaagacagcaggtatgaactactagaactctttttgctaaaaaataggaaagaagagtaagccagaaagaattcttctgtgctagacctcactacacatgaggggcaattacttgtgccaaaccctaat

SEQ ID NO: 561 - DNA, 661 bp, Homo sapiens
  KIAA0804
  misc_feature [331]..[331]: Chromosome 3, SNP identification no. = rs10446349
  misc_feature [331]..[331]: allele = c, in linkage disequilibrium with rs9830734, respectively
  misc_feature [331]..[331]: n is a, t, c or g
cttttagaaaaattactgcaatgagttttctctctgatgtgtttctcttccttatataacaggatgatgattctgacctagctgtggtcagctaattcactgattttgttgatgcctgctattttacagaggatgcaagtattcacttctattgaaacaaaaagttcctattaagaaacaatgcttctagatatacaaatagactacttgcgtgatgagggctgtgatcacaatgtgttctgaaatgggacccaaaaatcacttcttactttagtttccttatgttcataacatactccttaccccagaatccaacagaactagcagtttngttgaaatctcttatttttatgttttatgttattttatctattctgtttatttctgatgattgaaaaaaagtagtaagaaaagaggtaatcctcttttggaaataacatttaaactgaggtaatcctacttttggaaataacatttatatctacagagttgctctcattcttcttatagcaagagtcaggtggtggatttggagatgtagtaaagatacgattattcaacatgtttgaacattttttatagatatgaaaaactataagaaaggatatgatgtggatactttgttttagttcccgaaggttgtaaagtttagaaagatcag

SEQ ID NO: 562 - DNA, 661 bp, Homo sapiens
  KIAA0804
  misc_feature [331]..[331]: Chromosome 3, SNP identification no. = rs13066369
  misc_feature [331]..[331]: allele = c, in linkage disequilibrium with rs9830734, respectively
  misc_feature [331]..[331]: n is a, t, c or g
gagagactcaagcaagaacaacaggggaaggtcagctttgaacttggcattttctcaaatgaagtgtggaaagtgatggtgaccaagtatatttttttatttaaaaaaaaaaacagtattaggtaatgtaaatatctgtcaaagacctagtgttctgctttgagaatcctagttcttggattcatcatattttatcctcttactttatgtcttatataggaggtaggcattgatgtagattatgctctaaactttttgaatttgatgtttggcatttcaatcattttttaataaaaagcaaatacaaataatatacctgctttggtattgnggtcactatttaaaataaatattacaaaaaaaaaggcatatcacaagtatcaaaggtcttcaatggacagtcttgctcccttcttacctatatctagatttgaaagatgttagttaggtaagaccctttatgagtgctgtgaaagttgttttgttcaccagtaaaccacagatcattttacttgagaaacaggtatattttatttccctaagctaaccctaaccaggataattacctctcacacattattcctttcctgtcatatcaattcaggcgcaaggtcctttcttaccgaccttgaaaagagtcagcgtgctcacaggccttcct

SEQ ID NO: 563 - DNA, 661 bp, Homo sapiens
  KIAA0804
  misc_feature [331]..[331]: Chromosome 3, SNP identification no. = rs9870352
  misc_feature [331]..[331]: allele = c, in linkage disequilibrium with rs9830734, respectively
  misc_feature [331]..[331]: n is a, t, c or g
cgcagaaacagttaccaaaatctataaactctacctcttctctgtctcttatatgtgatttttcttcttgtctttacccctactgccctggtttaggcactcaacatccctcctctggtttcttttgctggtttcccaactgtaatctcccaacaggttcttcctgctacacggaaaaaccaattcactgagaccacaatattacagtagagaaagagattaattaacacagagctagccacatgggaggtctggtgtaataacttgagtcagtttcctggagaactcagaggctggggcttttatggataattaggtgggcaaggagctngggaatgggcactgctgactggttggagatgaaatcatagtagtgtggaaaatggtccttacgtattgagtctgcctcagtgggggccacaggaccactttagtcatgagtcccaggtctggttagagtcagaagatggccagaatgcaaaagtctgaaaacatctccaaagaccaatcttaggttctacaatagtggtgttatctataggagcagttggggaagtcacagatcttacgatgtctggccatatgactccttgtgcagcaagggattatagaaaggcaagctaggttacagtggctggctgccatttagctacacctatat

SEQ ID NO: 564 - DNA, 661 bp, Homo sapiens
  KIAA0804
  misc_feature [331]..[331]: Chromosome 3, SNP identification no. = rs4422281
  misc_feature [331]..[331]: allele = g, in linkage disequilibrium with rs9830734, respectively
  misc_feature [331]..[331]: n is a, t, c or g
gttatgtcctgccatcaggcagatagaggcgggagcagagagttcccccacattttcattgtttttaacaatcctcaatattttggggagatgtattttgattgttctgtgccccctttgaaactttcctttcagaaagtttcacatattaaaagctaggtgggtagctctggagagattttgggttagagattttgacataagagtttggcagaggggagaaaatcatagattaaaacaagtggaaaggaacaaatttgggtacattgtcccataccttattgaaacagtcttttagtcctgagaattactctgttcagttgatcagttntatcttatttcaggaggtgatgttgtgggcaggtttttttttttttaaatcaaaatcaactctatgatatagacaaatatatttagcaagaggcatgtctgtgggagcaaaagaaaaacaaaggttaatgtttggggcagtctgttagcttgtttaattctggagcagtcagctgagaagatttttatatttgttttcaaaatatctacagttggagtaaaagtaaactggtgattctgacagatttttctggattgctgtttgcgtcaaaatttcagtgaacttttttccataaataatttgtatgatttctttgaagtttatatcaag

SEQ ID NO: 565 - DNA, 661 bp, Homo sapiens
  KIAA0804
  misc_feature [331]..[331]: Chromosome 3, SNP identification no. = rs9820111
  misc_feature [331]..[331]: allele = t, in linkage disequilibrium with rs9830734, respectively
  misc_feature [331]..[331]: n is a, t, c or g
aatctgctttgttggaatttattataagaaacctcagattatacctttaaaagactctacaggccaagaattcaagaccagcctgggcaacatagtaagaccccatctctaaaacaaataaaaatgaaaaattagccaggcatggtagtcacacctataatcccagctattcaggaggctgaggcagaaggattgcttgagctaaggagtttgaagttaacagtgagctgtgattgtgccacagccgttgcactacagcctggatgacagagggagacctgtctccaaaaaacaaaaaagggtcttcagggcaggaagtcaagccacggantttaccagtagtaaatcagtggccagcatagtaatcagattttaccagtagtacttgggtgaattcatttttgcttggagtccccagaatattctgaggttcctgggcctgtcagaaagtgacattctttacttactgcaaggctgggaaccatgtagacatggcaccaggctagttattctaagggcttcaatggccccttaaagttaaccttagtttcttaaagtagtctgaaaatacgacatcccagcctgtatagaattagaatgattcaaataacatttatacctgatgtggttatagagctaaattattcctcctgtccctgaa

SEQ ID NO: 566 - DNA, 661 bp, Homo sapiens
  KIAA0804
  misc_feature [331]..[331]: Chromosome 3, SNP identification no. = rs6784179
  misc_feature [331]..[331]: allele = g, in linkage disequilibrium with rs9830734, respectively
  misc_feature [331]..[331]: n is a, t, c or g
ctagacatggtgactcacacctgtaatcccagcactttaggaggctgaggcaggtggattgcttgagcccaagagttcaagaccagcctaggcaacatggtgagaccccatctctacaaaaatatcaaaaattagccagcgtagtgccccacacctatagtctcagttactcaggaggctgaagtgggaggatcactggagcccaggaggcggagattgcagtgagttgaaattacagcacttcactccagccaggacgacagagtgagactgtctaaaaaaaaaaaaaaagaatttgatgtatgtttttcaaaactgatatatatttttngtcttccctagaaatggttcagtttacagagttataatttgaaatgattttcacaatctgagtaagagtggatatgtgctccaacctgaattctgtagtaggcagggtttgtgtgtgtgtttcacaaggcacacacatgctttcttctaaaactgacaaaagaaagcagtgggtgtattgcaaagcagatagttaatagaagactaacagatagctttgggaaatggatataacaaatttatgtgcaagactgataagcaacagtcagaaatggatgtaaattcattaatgctccagctaatttattaaagttttgattatattgatgtg

SEQ ID NO: 567 - DNA, 661 bp, Homo sapiens
  KIAA0804
  misc_feature [331]..[331]: Chromosome 3, SNP identification no. = rs7623170
  misc_feature [331]..[331]: allele = g, in linkage disequilibrium with rs9830734, respectively
  misc_feature [331]..[331]: n is a, t, c or g
cgtttacccacctctggtatcacaaagctcttaaattagggaaaatgccctgtgtctaaatacagtctctttttctttgacccaagcttcttattagtaaaagtagaagcactacttaccatcacttatgaataatcacaaaatccaaattgttctttctggagtccagagagtcccaccctgtggctattgatgtactgtacatggttacaagtgtgcctgcagactgtctcagctcttgggacaaccagagtcccttgtgagcaatcttacttcactacagtggaccaaacaaatatcttattttctgtgtgccacaatatgagaaaanctggaaactacttctttagaccatgtgctttaacctttcttcagaactgggctagttttccaagcaatcattgttgtatcttattaaccgtattccagttatttatataataatgagctttagttgaggaattccgaagagaagataggactctcagaaggaactaagttcttttgaagctagagagaggatgattcttaggtctccaatgaacagttgatttcctaagcagctactttcggccatcagtagttgagtgcttgagtggccagtatgatgcagttaatactctacttccaaaacttttgtgtaggcattgtgaatagcggg

SEQ ID NO: 568 - DNA, 661 bp, Homo sapiens
  KIAA0804
  misc_feature [331]..[331]: Chromosome 3, SNP identification no. = rs6765821
  misc_feature [331]..[331]: allele = t, in linkage disequilibrium with rs9830734, respectively
  misc_feature [331]..[331]: n is a, t, c or g
ctgcactccagcctgggcaacaagagtgaaactccgtctcaaaaaaagaaagaaagtgactttcgtcaggcttcttccagactgctgccgagagaatggcagacgaaaggcatctctggaactggactgtcccaattcagatctgggctccaccaccaaccagagtgaccttggcatatcactgaatcccaggacctgagtttcttcacctgtaaaataacaataagaaaagtacctacctcgtagggtttttgagatcattaaatgagatgatccatgctaagtacctgtaacagtgactggcacatggttattacacgatcgataaagngagccgctgcagcaggggagggagggttgtcgcatctgagaaaacgtaaaccagtgtttttcccctgtgctgtgaacggtcaccatgttgtttctttttaattgtggtatcgaagggcttgggtttttaaggttatttttcactgagcctttcagtctgtctctgtggcctcaagcactcgcctcccttagaactgctcattctagggtcatgactactactctaaatgaatctcctgcagagactttctgccacattttcccctcctctctctaggcagcttagcaacttgtctgcctgttgtagtatttcattacctaattcattatt

SEQ ID NO: 569 - DNA, 661 bp, Homo sapiens
  KIAA0804
  misc_feature [331]..[331]: Chromosome 3, SNP identification no. = rs6783157
  misc_feature [331]..[331]: allele = a, in linkage disequilibrium with rs9830734, respectively
  misc_feature [331]..[331]: n is a, t, c or g
gaagctgggagcaaagaggactcacttgaaggagaaggtagaatccaggggttccactctggaacccctgagtttgagttggcagctgggtgtctgtttgaggccttccaggttacagaagagaggtcagagccagtggtcataattagtcattcaccccgaggagagtgcaccaagatggagaggttggaacaagcagagctgagaacagagctcctcagcccagggcgcgtccacagggagagaagggtggcagcagggccatccacagcagctggaggagccctcagcacagggccagcccagggtgggagagctctccagtgccagngagagcacagtttgagtgcccttgggagcaaaccagtccagtctcattattgaatgaggaaatttagaccctaaaaaatgaagtgaacttgcccaaagtcacactgctcgtttgtgatatatggacctaagattcaaaccctgcatgttactactcctgcaacacagcactgtctctcatgtatctgaagcagtggattcaggagcctctcttccctctgctccccacaaaccttagctgatgtgtgtccttcctttgcagctggctctcctcacggaactctcccagaatcgcagcagcgagagctataggccattcagtggctcgcag

SEQ ID NO: 570 - DNA, 661 bp, Homo sapiens
  misc_feature [331]..[331]: Chromosome 3, SNP identification no. = rs12636670
  misc_feature [331]..[331]: allele = c, in linkage disequilibrium with rs9830734, respectively
  misc_feature [331]..[331]: n is a, t, c or g
cctggtggtctctcattagctaacgagagaccaagttgactgtacaaaggcagttgagtattggggaaaggctattatttaaactaaagtaaacatcttccaaagttagcttggcctaagcacgggaataattaagggtagcttgaaggccaaagacaaagtgagggttggcaggcgagatcttctacactgccggaattttctcactgttaacaagttttgcaaaggtggtttcaaatggatgcgtctatatcacacctgaagatagttacagtcaatttccagcttcacggaattctcccctgcgcctttttcttccctttgagcctcnaggattgctcaatcgttcccttgggcaagacactgggctggctgcggtgaacacaaaagggagccgtacacagccctgccctcaggcacctgccggctggggaaggacacgttcagcaggaaacgctcccatagctctttaagcatttgtttctattgttatactttagttcttaaaaaagatggcctagaggttctttgctttcaggttatacatttgttcaggtgggatgtattgtcccaacctacctctatgtgactttgttcatttattttgggcacttttagaagagaatctgggcttcgacctttgtgaagattcactcttacc

SEQ ID NO: 571 - DNA, 661 bp, Homo sapiens
  FETUB
  misc_feature [331]..[331]: Chromosome 3, SNP identification no. = rs3733159
  misc_feature [331]..[331]: allele = t, in linkage disequilibrium with rs9898, respectively
  misc_feature [331]..[331]: n is a, t, c or g
tgacctttaacgtcacgtacaagtcttttgtcccaccgtaggtcatcttacctcacttctcaaccacatcagaccctttattaccgtctctatcgttctttccttcggactcccttgtcagtatctttaatatggtaaatacagtctgacttttacattctagactacgtcgtatatttacatctccatcaaatcattctaattaacacccttctcctcgtcatatcatacttaaagtcattcctccattcatgacctttataattctttgaccgtaattcttatttgtcttttattcttactctctatgggatatgtaagaaccgtttcnggaccaattcatgagaaaaggtaggaaataattttgattgttttagcatcactaaagaatggacccgcttctcatgtcaatattcgtcgatttatctcttgagatgaacccaacaagtatattttataacgaaacgtaactggtatttggactttggttgtttacgtaaaatactgtatcgcttacgttgatactcgaaaattttatggaggttttaatttcagtctgtaaaagaaaatttcatcaatctttgaattctagtttaagacaccaaaaccgaccctccttgacgtcaactactagtttgacaaattggaaagggatcctgtg

SEQ ID NO: 572 - DNA, 661 bp, Homo sapiens
  misc_feature [331]..[331]: Chromosome 3, SNP identification no. = rs1868154
  misc_feature [331]..[331]: allele = a, in linkage disequilibrium with rs9898, respectively
  misc_feature [331]..[331]: n is a, t, c or g
aatattacgtattaacgaagtatgtgaaaaacgataaacttatatacattatatatacaaaacgtagtaatcttaataagacatgtatgtccacaaagaaagggaggtgacatcaactcgtacataaatgaatattggagataaaaaaagtccataattatctttggtatattcgaaatatttacaaaaacacaaaaatatcctaaaattttaaaacaataaaattcatatgtcaaaaatcagtatttgtgttagggacgtgtttcattttttcgtttgttataaaatcttataacattttatttttaattcagagaaaggaggtaagaantggagggtttgagaaagggttctcttcctgaaaatttttagggaacaatatataccgaatttataacataaaagggaattccaatatggtactcctgaaagagtctagtaatttataagaagtctttctaataaaaactccaatgtattataacctacaatacatgcacaattacataagttgtaaggggttaaaaaccggtacatataacaaaggttaataaacaagaatattcattacgatgtcacctggagaaacatttagagactgatacagaaactcttagtgatctgaccaactgtcttaaaatactgtaaattaaaaaaacat

SEQ ID NO: 573 - DNA, 661 bp, Homo sapiens
  misc_feature [331]..[331]: Chromosome 3, SNP identification no. = rs11720187
  misc_feature [331]..[331]: allele = t, in linkage disequilibrium with rs9898, respectively
  misc_feature [331]..[331]: n is a, t, c or g
aacctggagtgactgaaatgtcatcctaacttctaccctctccccagatgaacgggaaagagttttttctctagcccaatctcacgctgataaccgccggcttcacgagccagacctccaggaaggcattagagcagttccccgagaagatccccaatggaactatcagacaaattccccaggtatagctaggtgagattacatgattcctgcctacttgaaaggcttaaaaaggcagcttacaaagctgttaattatgacaagcttgaagagactacccaaggtagagacgaaaacccagcccagttcatggccggcttagcagcaaccnttggacgctataccgccctagacccagaagggccagaaggccgccttattcttaacatgcattttatcatccaatccactcctgacattaagaaaaaacttcaaaaattagaatctagccctcaaaccccacaacaggaattaatcaatcttgccttcaaggtgtacaataatagagaagaagcatccagacggcaacgcgtttctgagttacaattacttgcctctgctgtgagacgagacccagccacacctccagcataggagaacttcaaaatgcctcagccgcacacgcctaagccgcagcagtcaagcattcctacaggacttc

SEQ ID NO: 574 - DNA, 661 bp, Homo sapiens
  HRG
  misc_feature [331]..[331]: Chromosome 3, SNP identification no. = rs9898
  misc_feature [331]..[331]: allele = c, t
  misc_feature [331]..[331]: n is a, t, c or g
aatgaaaactctgggaagaagttggagtgcaggagaggtgatttttcacactctactttatcatatatttattatttgaaccttttcagtgaactggtattcaccttatcacttaggtgatacatttttaaaaggcagaaaccattttaaaaaatgacacatactggtgattttgaattctcatactgccttaaaaaatattgaatggtagttatctactgcttttttttcctttttctttgtctgttcttgaaactattttgatcccatctgttctagagaggaggggaaggaactggttacttcgtggacttctctgtgcggaactgcnccagacaccatttccccagacaccccaatgtgagtataagaaatgtctgtgatcgttgactagagtcacagagaaaaaagaaagagaagaaggagaaggagaaggagaaggagaggaaggagaagaaggagaagaggaatgagaaggagaaaatgaggaggaggagaaggaggaagaaatgtctgtgaaatacaaagtatcatctgggaagcacttagtacctgccaggcactcttctaagtgatttacacatcagataacttattgttttgttttgtttttgagatggagtttcgctcttgttgcccaggttggagtgcaatggcacag

SEQ ID NO: 575 - DNA, 661 bp, Homo sapiens
  HRG
  misc_feature [331]..[331]: Chromosome 3, SNP identification no. = rs1042464
  misc_feature [331]..[331]: allele = a, in linkage disequilibrium with rs9898, respectively
  misc_feature [331]..[331]: n is a, t, c or g
gacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccccgtcccttccattgcagacaaattggatctgtgtaccgactccctcctctaagaaaaggtgaggtgctgccacttcctgaggccaattttcccagcttcccattgccgcaccacaaacatcctctaaagccagacantcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatca

SEQ ID NO: 576 - DNA, 661 bp, Homo sapiens
  misc_feature [331]..[331]: Chromosome 4, SNP identification no. = rs6814552
  misc_feature [331]..[331]: allele = t, in linkage disequilibrium with rs10516168, respectively
  misc_feature [331]..[331]: n is a, t, c or g
agcagtaaatagatcagactccgcttctccaagtgaacctcagaagcaggaatgaccccttctagactgagcaagcctctaagtatttcaaacgattatgatacaggtgcagggtgggttcaggtgtgtggaaaggtgacctcagagggaaaagagcttctgctagttggacacaaaagcctttggtgattgactggcaaagttcagaggtgtccactgtgcccggagttggtaaaacaaagaatacaggttgctacataaaaattaataagggatgacttcctcccctcactttccagcatgcataaaaatagcagaagctttagcagantcccccatgctgtaggtgacagagcttcagcagtgacttcttcttgtttcccttctggcttttcccaggaggcagcttaggtttgaagcagcatttcactttccatctctaaacaagtaccatatgtttacaactttgggagttctcactcctctttctggagtcaagggtgttccctgggtggtgagggaaagggtgtgtgctttggaaggtcgggaaggtgacatttatcaagtgcctgccatgtgtcaggacagagctggctggatgtttaacctctattatatcttgatgtgtttttgatgtgtgccccacccaaatctcgtgtcg

SEQ ID NO: 577 - DNA, 661 bp, Homo sapiens
  misc_feature [331]..[331]: Chromosome 4, SNP identification no. = rs2089781
  misc_feature [331]..[331]: allele = c, in linkage disequilibrium with rs10516168, respectively
  misc_feature [331]..[331]: n is a, t, c or g
ccaagcagcctgtcacccagcccaggggacatgagctcctgattttacctttgacatgtgttttgtaagcgaagtctgatgggacaatggagcatgcacatgggcagaggagctccatgccatgtgtgtgcccagtgttcctgtggccctttttgcacaaagcatctgtgaggccccagaggtgcggggtgcataggaattcagcaggactcaaatcaagtccaaggaaagcaggttacatgtgtggctatggaggtcgtggggtggggtgcagtaagaagaagctgcactttctgttccaaccaggacgtgcttcaagtgcagaaagaanacaatgacattctaagcaatgggaatgacccattctgtccttgccttttcctgctacttccttggtataagacaaccacctatgctgacaatgatgacagagaaagaaaaagaaggatagggaaatcacaggctttttttcgactcagtacttccttagtcctccataagctgaaggtagaaagtggtggcagaatgcgttcatctcaagacgtaaactaaaaacagctgaattggctttgtgcagtgtttccagttttggaaacaaggacatgcacaatacgccacacgaatgtgtgatttctgcgatttcaccttcaagttaattact

SEQ ID NO: 578 - DNA, 661 bp, Homo sapiens
  misc_feature [331]..[331]: Chromosome 4, SNP identification no. = rs13149006
  misc_feature [331]..[331]: allele = g, in linkage disequilibrium with rs10516168, respectively
  misc_feature [331]..[331]: n is a, t, c or g
atttctgcgatttcaccttcaagttaattactcttatatgtgcattaaaactggcatcacatgctatgaagttgaaccatgaaattcatgctaataatatgaaattttaatttaaaaaacttacaatgtcattaaataacaaattaaaatacaccacagcaagtccagagagactacaaaagaatggaaaacactttacatttctgtacatttttgttgctgttgttctgtttttacaaaaaggggccctgagctcagctcctgggggggcttgtttgcttttaggccatggctttgtctgttgggaaaggaatcttcacaagtcctgacncctctccaggcctcagtctccccactgttaaaatcaaaagagcaggaaaatagtatcagaattgtggacagagactagacttggtcagacagaatggggggtgggaccctggctctaccagctcatagctgtgggtttggacatattgtttaatccctcagaaccttgatttcttcatctgaaaagtaaggccacccatgctcactttgcagtgtggctgtgcgcattgactgggtgtgtgctgactgtgggggctaatcttgagtgagttgcctgacctcagctttaatgtcttcatccagaaaataaggaaaatcatactccatagag

SEQ ID NO: 579 - DNA, 661 bp, Homo sapiens
  misc_feature [331]..[331]: Chromosome 4, SNP identification no. = rs10516168
  misc_feature [331]..[331]: allele = a, c
  misc_feature [331]..[331]: n is a, t, c or g
aatgtatgcaaaatgttttgcttcttttctttcaaagaaagctgttactaaatccatgatgcttctgataattgatggtgccttagaattgaggaaatagaggctcccctccccaagaataccactttggttaatgtgctcccaggaggaatctccttggtttttaatatccaaattttatagactatctatatctcatagtacttcattttgagggatgagtgtttacatttaaaagttatatttatgtctaaataactcaacataacattttccctaaataaaatgatgagtaagaaaagtctccaattacatcccaaataaaatccgnagactctcagaatcatatatacacatgtcaaccaaaggagtgtgtgtttcagctgatgttggcactgaaggaggccttccatattctgcccggtgtgagccatctgtgctgtcgtgtgcttgtccacagtgatgtcaaagtgcgcccttgcttttgcctggtgttgaacaatatgtcccctcaagagttgagtattatggcgaggaaactggttatggtggaaagaaagatgctatccaacaagaagtacatcagccagctattaagtaacaaatcacccccaaagctcagtgacttaaaacaccaatcatgcatcttcagggtggaggt

SEQ ID NO: 580 - DNA, 661 bp, Homo sapiens
  misc_feature [331]..[331]: Chromosome 4, SNP identification no. = rs767564
  misc_feature [331]..[331]: allele = a, in linkage disequilibrium with rs10516168, respectively
  misc_feature [331]..[331]: n is a, t, c or g
ggaaggacaaggttgtaagacgaagggtggagggtaggtagggtaagtatttttaacgaggttgtttaaacgatttcactgtataatccaaaaatgtgtcagttataattcggtccgtaagtccctctgtctctcacgtttctcggtgtaacctaccggtaccggtaggtctcgggaacaccagtagagtacctaaagaggtgaaaagtggaatcggaattctcgagaccttcttaaggtcggtgctagatcaaaaggaggacggtaaggtaatacaatgtcgacataattctctttttctagtgtagatgatggtttttaccgaggtagngtcataaagggtaccaaagacggttgtaacgtgaagggaccgagaccgtcaccgttcttgacctccctagtaccacaccacgagtcggtcccgaggattagtgtatcgacagaagtgtcctctctccttggtcccgagtcttttcacgtacaatcggagtaactgaaccaccgcggaccctgcacgggtccccgaagtaacactgccagaacctctacaatgtctaatctcatccgatagtcgatgcgaagggtgaagggtccatcttctatgtgtttcttgacccgattaaggacgaacaccgtacttgaaacactgggtttcacgcaa

SEQ ID NO: 581 - DNA, 661 bp, Homo sapiens
  misc_feature [331]..[331]: Chromosome 4, SNP identification no. = rs11726886
  misc_feature [331]..[331]: allele = a, in linkage disequilibrium with rs10518098, respectively
  misc_feature [331]..[331]: n is a, t, c or g
tttttcatccagtccatgacaatccgtttcttccagttggttgagccaatttgactctagtcttttcctcatatgacaagtccaatctcctagtaaatcttttaggctcaactgccaaaatatacagaatctggccattcctcatcacttccactgctaccaccctggttcaaaccatgattatatctcacctgtgtcactgcaacagccccttaggtggtggctgacccttcagcctatttctgacccagcctcccgagtgtaaaatttgagtcagataatgccttgctttaaatcctttaatggcttataaggtcctatagattctggnctcctccctgaattgatctcctattgagctccttgttcattcaactgatctccttgttcattgtattaaagctgcattggcctaggtgttccttctctgagatatttatacatgcctggagtatttttccacacctacccacctggctgctcctgcaactcttgtaattctttattcatatgtagtcttcttagtcttctcagcaaggctttctttgacctttcagaattgcaactccttctccagtattccctttccttgtgatatgctttgggtgtgtccacacccaaatctcatcttgaattcccatgtattgtgggagggacccag

SEQ ID NO: 582 - DNA, 661 bp, Homo sapiens
  misc_feature [331]..[331]: Chromosome 4, SNP identification no. = rs10518093
  misc_feature [331]..[331]: allele = t, in linkage disequilibrium with rs10518098, respectively
  misc_feature [331]..[331]: n is a, t, c or g
caaacttcgatcttccatccgttcgggatgttgcacaatttctttcgactttttagtgacttttagagataaggatgattgacctcgatccgtccgtccaatcagagtgattaatgaagatccctgactcgttttggtggagtacattgttactgacgtagacagttttagggtttaggggtgtctccgtcattgagactctgtacgaataaaccgggtcaagacgtgatttttttttttttttttgtttgatggttagttatagtatcttcctattaaatggactataaaaatccattgacaaactagttcaccgttatttaatcatttncagtacgtttgttttcgtttactaatctaccgtggacgtgttccagacgacctagtcgtaagtaacctctttttgagtccttttgtcctaggcatcgtctgaacatataggaaggaacgaatagtgttctaaccgtcggatctcgttaaatcgtcacggtctgcattttgaagtcgtctctagaagtatgaacccgttgtcccgaagctcctcggaggaaaaaatttgtcgagattggtaaggggaccacaatagtacccaatactatattatcgttatattacattgtcttacacctaggtcggacagaaggactgtagagatgtaaac

SEQ ID NO: 583 - DNA, 661 bp, Homo sapiens
  GPR74
  misc_feature [331]..[331]: Chromosome 4, SNP identification no. = rs4129733
  misc_feature [331]..[331]: allele = g, in linkage disequilibrium with rs10518098, respectively
  misc_feature [331]..[331]: n is a, t, c or g
caatttagaatgtaaaataatgcttataataataataaatgttctatcaggtattatagaatactagatggtcctacattttagttttctagataattgaagttttccctaaatagaatcaataatttccaaaagggttacctacttaccacatatctttctaaagtacattccatgtattttgttctttctacatagggcaaacttttaaaatttatagtttcactaataattcagtgtcaacacttgcattatcaaataccgtttttgtggctataatatattattgtctttagaaaatgtgtgaaattgatgttccctacatgaaatnttccaagactttatgcctttttaaatatgtcagtgttttatagttttcctctgtctttctttattcaggcttttatatggcccttttctagttctgtagtgattctgtcttcatcagcttttcctctctcaattctaatctattgtgaccagctcataaggtaaccaagctaattagaataatgagtttaataaaattggtctgtgagtaatgccttaaaatatggactttatagtaaaagcttcactgtagtcttttaactactggagacttttccttgttttcttcctgcttctggattcttgaattgaaattgttctttgaagtttt

SEQ ID NO: 584 - DNA, 661 bp, Homo sapiens
  GPR74
  misc_feature [331]..[331]: Chromosome 4, SNP identification no. = rs4337703
  misc_feature [331]..[331]: allele = t, in linkage disequilibrium with rs10518098, respectively
  misc_feature [331]..[331]: n is a, t, c or g
ttcatggctttttactcatggatgtatttatttcaataaattatatttgtagaaatgaaaaggtcaagtggaacataatgcacattttgatttgactggcattcccaaattcactttcaataagtcttatcattgtatccctaacactgtatgaaaatatttgcttccctgcatctgttgtcagccaacatcagatatcattaatcttttaaatttttgccagtgggatggatgtgaggtttgattattagaaatatgttcgctgtgactgggagggcatgggaataactgcgtctaaacaaggtcttagaccaagtctgagcatgtgtgnccttggtcttataggcagaggtgtagtgggtactattgggttcagctgatccaaaatcagcttccaagtttacctcaaataactcccctgggttgtctcctatttctgtatattgtaattctgatcttggagccatctctaaagcctccattttcatgaaagttctttcttagatgagttttaacctagaatttcctgcagtcttgtttctctttattcaaccttaacagccttttgtgttctggtcctttaagagcactcttcttttgttttccaatgtatctatagattgtttattaatagtcttcactattttctttagaactttta

SEQ ID NO: 585 - DNA, 661 bp, Homo sapiens
  GPR74
  misc_feature [331]..[331]: Chromosome 4, SNP identification no. = rs11733404
  misc_feature [331]..[331]: allele = a, in linkage disequilibrium with rs10518098, respectively
  misc_feature [331]..[331]: n is a, t, c or g
gcactcttcttttgttttccaatgtatctatagattgtttattaatagtcttcactattttctttagaacttttaatttagacttcataaaaggtattgttgcattaaagtggttctcactttcgaacaagtcattaaaattgatcattctagtttgggacaatattaatatctcttggattgtatgggcaatgaaactgtagtattctaatacacacattagaattaaaattaaaaattagtcatttttacacattgatttatacatttattaaaataagaatgaaaggatgccagagtaggatatccctagcaatatgtttttccactncatatgtttattgttttgaaactattgcatagattgcagcatgcaaatatcaaactttaatgtttgtactaaagaaatttttttctgtaacaagctgtgtgaatatgcttgtgtatatatttttatttgtagacatgtttatttcactagattatatttgaaatttactatactattaagtagaattccactgttaaggtgattatttaactataatctgctttctttcataattttatcatagtaagaaagctagtgaacttaaatttgactacacatggatataaagatggggacaatggacactggggactactagatgggaaggga

SEQ ID NO: 586 - DNA, 661 bp, Homo sapiens
  GPR74
  misc_feature [331]..[331]: Chromosome 4, SNP identification no. = rs11737827
  misc_feature [331]..[331]: allele = a, in linkage disequilibrium with rs10518098, respectively
  misc_feature [331]..[331]: n is a, t, c or g
taagccaggctccctcctctgcttttgtcaggttgtagcccggcaggactgacagtaaatcagcttgcatgaacttgggtctactggcctcattcctttctcggctgtccttccaattatcccttacagtagtcacttaattccttttctttttaaccttcctaattatcctcatttttacatttaatttctgcttttgatgctttggtttaatctgttggcatatgaatacatgtttaataatcaatttttaaaaataaagaggtttcatctttagagtttgccagttctcatggtgtaaatatatcaatcacagtcaacttcaagcagnaaccataacattactgaatgtgcctttgggcagagatgtgcacaattggctctcactgtaagctcactccagaacaccagtatttgtattcctcattaccacgaaagctgcgacatggtctacttcattgttccccagttcttagaacagtacctagcatgttgtcaacacagtcaatatttgttaaatcagtcaatgaatgaatgaacagaagatgttccctcacttccaagaaagagtacagtgaactgtttccctgatggaatgtccatgtgattctggccctttaccacctgcttcaggaatccaataatgaaagaaaatgtaaac

SEQ ID NO: 587 - DNA, 661 bp, Homo sapiens
  GPR74
  misc_feature [331]..[331]: Chromosome 4, SNP identification no. = rs12651098
  misc_feature [331]..[331]: allele = c, in linkage disequilibrium with rs10518098, respectively
  misc_feature [331]..[331]: n is a, t, c or g
tttataagcccactgtcaaattcattttcatttatgggcagatataaccttctgttcaattaattaacaaggtgtgcagaaaagagataacaagcaggcctgaggctgctacccttagaaaagcctgcttgctaagttggctcttggttggagtctgggaacttaaataataaacacttcctatactgatacacaggtttacttaaatgatgagtggctcactatgcctagactgtttgtacaaacaacatggtttatgctgaatatctactttctatctgggagtctggaattttgatatatgctaggaagaagatccccacttgatcancctccaagaaaaaccctgggtgttgagtctctagtgagcttctctggttgacaatactttacatgtgttttcacaatttgttactggaggaattaggcatgttctatgtgagtccactgagattaagtgcatggggcctatgcctaatttcctgcagtcttcaccccatgtacattttccattcctgattttgttttgcatccttcactttaataaatattagtgtgaatgcattatatgctgggtcctgcaagtctttctagtgaatcaccatacctaggagtagttgtggggaagctgtctacattaagacatataggccgggtgcgg

SEQ ID NO: 588 - DNA, 661 bp, Homo sapiens
  GPR74
  misc_feature [331]..[331]: Chromosome 4, SNP identification no. = rs11734943
  misc_feature [331]..[331]: allele = t, in linkage disequilibrium with rs10518098, respectively
  misc_feature [331]..[331]: n is a, t, c or g
gcctccagctccatccatgttccgtcaaaggacatgagctcattctttcttatggctacatagtattccatggtgtatatctaccacattttctttattcatctaccattgatgggtatttagattgattccatgtctttgctatcgtgaatagtgctgcagtgaacatacacatacatgtgtctttataatagaacaatttatattcctctgggtatatacctagtattgggattgctgggttgaatggtagttctgtctttaggtctttgaggcattgccacattgtcctccagaatggttgaactcatttacatttgcaccaacagtntgaaagtgtttatttttctccacaattttgccaacatctgttactttttgactttttaatagtagccactctgactggtgtgggatgatatcccattgtggtttttatttacatttctctaatattcagtgatgttgagctttttttcatatgtttgttggccacatgtatgtcttcttttgaaaaatatctgttcatgtcctttgcccactttttaatggggttgtttattttttgtaaatttgtttaagttccttttagatgctggatattagaccttagtcaaatgcaaagtttgcaaaaattttctctcagtatgtaggttgtctc

SEQ ID NO: 589 - DNA, 661 bp, Homo sapiens
  GPR74
  misc_feature [331]..[331]: Chromosome 4, SNP identification no. = rs9790741
  misc_feature [331]..[331]: allele = g, in linkage disequilibrium with rs10518098, respectively
  misc_feature [331]..[331]: n is a, t, c or g
gggataccccttcactgataccctaacaactctcttcacctctctttgtgtacaaccccattttctggatgccatgtccccttctttttttggtttattcctttctgagaaatggtttattgagatgaaacgtttgagctcttatttgtctgcaagtatctttattctgccctcacacttaattagttagctgtatgaagaagtctaggttggaaatttcttctgtcagaatttcaaaggaattactctattgctactgctataaaatatggtattactgctgaaaaaacatgatatttaattctttcttcttttgcccatgatttgtatnttgtttttcttatggaaatcttttagaacttccctttatccctaatgttctcaattccatgaaactatgctttgaagtaagcctttttattttgtatttattgtgctggatataaattcgggctttgcaatctgaaaatgagtggcctttaatcttagggaattttcttgtggagttcttttctgtttttctttcttctactcatattaatcagatattagagattctggattgctcttttaatttttttcatctttttactttaattttttgcccctcattcttctattttcaaggattgtctcaactttctcttttaaactttatgtt

SEQ ID NO: 590 - DNA, 661 bp, Homo sapiens
  GPR74
  misc_feature [331]..[331]: Chromosome 4, SNP identification no. = rs11940196
  misc_feature [331]..[331]: allele = g, in linkage disequilibrium with rs10518098, respectively
  misc_feature [331]..[331]: n is a, t, c or g
tttattctgtatgtaactcctgattcctcataattttggggtgcctttccaaactagaaaaccgacgttctgactgtttattcatttaaagggcattattgcatcagagtcaatggtttagactctggagtcttacttcccaggttcaaattcttaaaatgctcctaactagccgtggcaaagtatgtaatatttgtttatttgttacctcgtctatattgtgaggaaaataacaaagccttcaaaagcctgttgtgaggattagatatgttaatagacagagaccacttatagtgcctggaatgtgataactactatgtaagttttgacnttattgttagtgtactgaaaagcagagctctggagatattaggggaaatactgagaaacattgatttttctctgcctatcatgtagaaaacagttacattagtctcgtttccacaactttctattttcattttcagtgagattttgaaaatatgatcttttgaaagactgtttcattttcctttcaggatggccatttggaaacacgatgtgcaagatcagtggattggtccagggaatatctgtcgcagcttcagtctttacgttagttgcaattgctgtagataggtaagtctgcaccaaactctgaatccagaaaaattggcatgtc

SEQ ID NO: 591 - DNA, 661 bp, Homo sapiens
  GPR74
  misc_feature [331]..[331]: Chromosome 4, SNP identification no. = rs10755169
  misc_feature [331]..[331]: allele = t, in linkage disequilibrium with rs10518098, respectively
  misc_feature [331]..[331]: n is a, t, c or g
attatcttttgattaacataatgaaattcaataataataacaagatccacaatatcaaaatcatagtaaaatgaatcaggcttactctacatactgatgctgaatttttgtactcaccagaggacatagaatgttaggaaggctcataatcagaactcataatgaatactctcagatttttacagctgtaaagcaaatcagcaaaacatttagtggcttcaaacaatattggtttattacatctcatgattttgtgggttaattgggcacctctttgttcatcctcctgctccatgtgttataactggaatcactcatgttgcagcattantctgggagctaaactggggctggaacatccaaaatggctaagctcttatctcccggaatctttctctacatgcctttcatctaattcaagcttcttggaaattgaagtctggattttaagaggaagcattccagaaggacctgccccacatgcaagtgtataaaaagcttctgcttgcatcatgtttgctaatatcctattggtcaaagcaagttacacagataatgcgtaggggaccacacaagagcctgagggataaaaggttgattgattgctacagatcagcagtctaccacagcctaagagctacccatctaaagaggacgatgt

SEQ ID NO: 592 - DNA, 661 bp, Homo sapiens
  misc_feature [331]..[331]: Chromosome 4, SNP identification no. = rs11729989
  misc_feature [331]..[331]: allele = a, in linkage disequilibrium with rs10518098, respectively
  misc_feature [331]..[331]: n is a, t, c or g
gagttttgttcttgtctccatggtcacaactaaccaataggcacatccatgtatacgaacatggggagggaaaggaagagctctagggcaggtagtgggtctttaaattgtggaaaacctggaaagtatacaaatcactgttgttcatatacagttagtgaaatttactcacatagccatgccaatcttcaagcacagctgggaaatgtagtcttcaggtaagcagccatgtgcccagtctaaattctactactatagaaaaaagagagaacagattgtttacatttttacattatcaaatatactattttttatttttgaaatctttttnaattttgattttagaaagtactttcaagtctttacacaagacatttgctttctgtggtaggtaaaataatagtttcctcccttccaagatatctatgtctaaatccctggcatttctaagtatgttactgtatttgacaaaagaaactttgcagatgtacttaagctaagaatctagaaatgaaaaaatcattctggattatttaggtagacccaacataatcataagggtacttctaagcagaagaaagatacagaagggagaggcaaaagaaactctgactataacagagatcagagtggcacaatttgagaaaaattgaaacctgtc

SEQ ID NO: 593 - DNA, 661 bp, Homo sapiens
  misc_feature [331]..[331]: Chromosome 4, SNP identification no. = rs4333153
  misc_feature [331]..[331]: allele = c, in linkage disequilibrium with rs10518098, respectively
  misc_feature [331]..[331]: n is a, t, c or g
tttgctaaatttcagaaaaacaaaagatcagagtattcagagagtaagcatgtgactcatagatacccttagccatctcagcagaagccaaaaatggaaatgggattatctttgaaaaatctgttgaggatcctcttgtctaatagaatttaatctgtggcctacataggagacccaccaagtttttgagaatgttatatcagcagaaaacattacctgattcaactaaaaatgactgagaggggatgacatgaaagaaggctctaaaatccccaaaattctataggcaaaaaacaagctgataaaactcttcaactgtaaaaggtgatangtttcatgaataagggaagatgacaataaggacagagttgaaaactcaaaaggcaaagccatgagcccacataaaagagctaagagcttagagggcggagccaagagctcagagggagtcaaaaccacaagccacagaaaattattcctagggcttagaacctaatggaatctgcatcactggatttaaaaaaatatttgggattggtgactcctatttttccttccattttctctccttttgagcaggaatgcctgtaaatgttatcctatgccggccctactattgtattttagaagcaggtaacctgcttgtttggtttataggtcc

SEQ ID NO: 594 - DNA, 661 bp, Homo sapiens
  misc_feature [331]..[331]: Chromosome 4, SNP identification no. = rs17775363
  misc_feature [331]..[331]: allele = a, in linkage disequilibrium with rs10518098, respectively
  misc_feature [331]..[331]: n is a, t, c or g
gagttatttatggacaactaaacgttgatataattttacaaacagaatttgatttcaatgatataatacatgatatttaaaataactcacttgagcttataattctcacaggcgaaatggttttattgttttataatgatatcatatactcttaatttcctctccactggaatcaaatctacctgattaatttggaagcattcatttgggcttgctgagctatattccactgagtggcaactagtgggtcatttagttttcacacattgaaatccacaagtggaacattcctgatatcaacataaaagcaaaattttgtaagccaccaaanaagcatctgtatgtatgccttgatggctacaggattgtacgttcctcagctttaccaacacctgttcaaactcacttcctgaaataacttcgttctattccaaagacatctaccaagcacattaggaactgttaaagtaatattcttgggacgtatttttctagtttaaatacatgtctctttcttgcattcatagaaatttacctaaaatatgtaataattttataaattattatactccatattcctaaatttctaagtcaaatgtattcaaggagatcttttcccaattttctgtcttggtaaaactcttcagtattatcagcgtca

SEQ ID NO: 595 - DNA, 661 bp, Homo sapiens
  misc_feature [331]..[331]: Chromosome 4, SNP identification no. = rs17718934
  misc_feature [331]..[331]: allele = a, in linkage disequilibrium with rs10518098, respectively
  misc_feature [331]..[331]: n is a, t, c or g
aaagaagcatctgtatgtatgccttgatggctacaggattgtacgttcctcagctttaccaacacctgttcaaactcacttcctgaaataacttcgttctattccaaagacatctaccaagcacattaggaactgttaaagtaatattcttgggacgtatttttctagtttaaatacatgtctctttcttgcattcatagaaatttacctaaaatatgtaataattttataaattattatactccatattcctaaatttctaagtcaaatgtattcaaggagatcttttcccaattttctgtcttggtaaaactcttcagtattatcagcntcattaatatgtacactagcaagataatccactttaaggataacaaaaaaatgctttgagacagtgttatgttaatatgttcaaacaagttacactattcaagtgacagtgaaaaagcttgtattcttatttttattttggtctatggtagaaacatattttcttgcatgtgaacatatcctgtcaaaataggtcatcagcctcccaaatgttaacttcatgcaatcctgtgctgtcttgtcactaggacttatgttttctatgtctttccagagtatcatttgcaaaccaaactgccctcctttaggcacacagcattattctcattat

SEQ ID NO: 596 - DNA, 661 bp, Homo sapiens
  misc_feature [331]..[331]: Chromosome 4, SNP identification no. = rs885521
  misc_feature [331]..[331]: allele = a, in linkage disequilibrium with rs10518098, respectively
  misc_feature [331]..[331]: n is a, t, c or g
tcgataaagactagggggacaccgaactcctttccctcatccccttcctcctccttttttactttaacaggtctgttccttcaagtctctcgtctcccagtcctcttcgtcgtctcctctgtcaaagacctcggaaggactaaagtcttcaccaagatgactaaagaaattgagactctgttaaagttaaaaaaaaaaatgattgaaggacctccctccgctcaaatagcaagagagaaaaactactaagatctacggtcgatttgatactaagagtaagtaaaagaaactaaaccatcggattaaaaagattagatcactatatatatantatatgtaccagtttattttgggtatactactcttaaataccaaatatcccgtactgagggatcttgggaatccatccttaaacccgttttattttatagttcgaatcacgagtactatttcccgttccatgggtaaaagtattaaaaggtcagaattagatatttatctatattattactgattgagaattccaacaacacttataattctgttacattcctttattgtacctttaatcgtatagtattcggagttatcaaccatctgaaacaatgacaatacgtatgtattcgtctatttttccgaaatattcttactaaacatcgac

SEQ ID NO: 597 - DNA, 661 bp, Homo sapiens
  misc_feature [331]..[331]: Chromosome 4, SNP identification no. = rs2137735
  misc_feature [331]..[331]: allele = t, in linkage disequilibrium with rs10518098, respectively
  misc_feature [331]..[331]: n is a, t, c or g
aatttaacacgagtaagtggtaaaacaaaagtaaggtactgtagtgagagtaataaaagggtgacaaagacgtacacttgtgaactcttgaggaacaagttgttgaactcgaggagtcttgtttcccgatatttagactgtccattagatataaatggttcctttcggacaccttcttattccgatttaagaaaacatttatttatttataaataaactttttattataaactcttcattttcattggtctttatagtattttctttcgttatttcttctttcactaatacaaataaaaatgtaaaaagaaagtctcttcggtaaaattcnataggttccgttcggtgtgatatctaattcgatatttgattagttggacaaaactcatacgtataccataggtcctgtagtttatctttgtttataataaacttgaaacagtattttataagatgtaggtaataagagttctctttaatggagtaaaataactattattacgacttcaatcagtaaaacataaccaatattggttaaaaaatttactcttttatgggcaattggtgttcatgggatttgtaatgatagagtttgtccggaccaactgtcaagaaaaaaaacaaaacaaaacaaaacactgtcggtaaaatattaacactc

SEQ ID NO: 598 - DNA, 661 bp, Homo sapiens
  misc_feature [331]..[331]: Chromosome 4, SNP identification no. = rs7675397
  misc_feature [331]..[331]: allele = g, in linkage disequilibrium with rs10518098, respectively
  misc_feature [331]..[331]: n is a, t, c or g
catacaaagcttgctgttacaaacctatgtttaaagactaagtggacatattgaaagaataaatgtccatgttcctgcctttgggcatttacacataccgttctctttctatgtctccctcttggaactttgtggatttcacctccaccttttaagtaaattccccacttacagcagctctttcctaagagatatccaaactgaattctgtgttttattacaactttcctaaccagctaaaattgctaaataactagaatctttgagggaccctggcatgacagacccttactggacctaactgattactctttctatacagaagatacantacagtggactcattctctcctatacagagtgttagtttttaatcctttgttaacataattatcatggcagttctgcagtaatgccacaaaaaataagcattcaaaatatatttgttggataagtaaatgaacaatataagccaaatttttcttctgtacactaattttaaatgttttcatgacaggtttgggaaagaaagtaatgattttacttttaaagtgtgaaacgtgtttacaaattttgacagattttgtgatgatgtatatattttctcattgataatgttgttatatagaaaatcaaaattattcaatgttaaagctttcaa

SEQ ID NO: 599 - DNA, 661 bp, Homo sapiens
  misc_feature [331]..[331]: Chromosome 4, SNP identification no. = rs10518098
  misc_feature [331]..[331]: allele = g, a
  misc_feature [331]..[331]: n is a, t, c or g
ctaaatttctctgtacaaacatattacctttctcgtacttgaaacttcagtttatgtagacccaaacttaggataaagacttcacatacttcagaagtatacaagattgtataattttttaattaacaaaaaggattagtagataaatagataggtaggtagatagacaattagatattgataggtaaataaccgtctttggtatagtacttttttttctgtacactttttcgagatttgacaagtctcttttgaacatcggaaaccccgatctgattaaaccgtgcaccgttctttgttctctacttcgaaacccttcattcagtaactntctgactctcagtagaaggtgtcacttacgtacgtctgcaacctgaagtagtacgtctacgaccccttaatagtaatcgataattcgtccttttcgtccttttcgtccttttcgtccttttatcagactaacttatatacacaaattttccctaaacatcttctgtaaaccttcttttagtctacctttttgtctgaattatacggaaaccattggagtgtaatttccgaaaaatacagtattttggttgtctataaaaaaatgaaacccttccagactagttagatataacaatttttataaaagaagatcttttcgatggtcatttat

SEQ ID NO: 600 - DNA, 661 bp, Homo sapiens
  misc_feature [331]..[331]: Chromosome 4, SNP identification no. = rs1554016
  misc_feature [331]..[331]: allele = a, in linkage disequilibrium with rs10518098, respectively
  misc_feature [331]..[331]: n is a, t, c or g
caatggagatagggttttttttccctatctctgctgggaaactaagtaatgtagggattagatttcagatgaagtctcagcttcaacctgatcctgcggggaggtggagaatgtaaattatacttcagaacctcagtaaagacttttactctccacttgtgagttattggttacgaaccacaggatgagggaaggtgaattgctagataactccagctccttggataaagcaggttagaacacccaaagggagtttcccaaaactgagttgcaggtgcaggtcattagagaaaactcacattgaaactggggggaaagacacacagaaaangtaagaagcatccaaaaagatccaatattcactacgatttcttacaatgaatctggtactgtggtaaagagttagagatttagaaataaatacatttcctgtataaatctgtaaaaaaaaaaactgactctattgcaatatgataaatactgcattaaaaatgtacaaagggtaaagagctcacagataaaaggatgattaattattggagctttttcaaatattttattattgagataacaaggatctcattgccaaatagactcatatgaatactagatcttagtatcaaacttttttaatatctcaaagatgcaagtgaacacaagg

SEQ ID NO: 601 - DNA, 661 bp, Homo sapiens
  misc_feature [331]..[331]: Chromosome 4, SNP identification no. = rs10938007
  misc_feature [331]..[331]: allele = t, in linkage disequilibrium with rs10518098, respectively
  misc_feature [331]..[331]: n is a, t, c or g
cataagcaaaaaagggggaaaaaaatctaggaaatccaaaaccttcccaggacattccagctggatcaagactcactctgacacagactaatgtgtgagatctcctctaagtaatgcatgtagcaaattagtgacacaaaaggggcaattttggtcatgcaacactcccgtctttatattcttatagtaatgtagcttacgagacattttccagggagccatgccccataactacataatttctagtcttatttatcataagtaatcctaaacagattctattcactctgttgaaattctatagataaaaactctcttattagcaaatacnattagtatcattgctaggacttctgtcattagtgtttatctggaggtttgactgggtcaccctgctgcttctttccttgtgtgtcccacagtaaaaggggagaaagagaaaatatcctgctgtaatttttctcctcatttacattctagttgcagtttccatcttaattgtatctcaaaataaatagttgtttcaatagatagctaggtagagagctgatcacaggtggttagatgatgggtaatatatatcataaaattaccatgctccccaaagtaatacataaattgccaaaatttcaatgagaatcacaatggggattgtcagtgg

SEQ ID NO: 602 - DNA, 661 bp, Homo sapiens
  misc_feature [331]..[331]: Chromosome 4, SNP identification no. = rs4444797
  misc_feature [331]..[331]: allele = t, in linkage disequilibrium with rs10518098, respectively
  misc_feature [331]..[331]: n is a, t, c or g
tcactctgttgaaattctatagataaaaactctcttattagcaaataccattagtatcattgctaggacttctgtcattagtgtttatctggaggtttgactgggtcaccctgctgcttctttccttgtgtgtcccacagtaaaaggggagaaagagaaaatatcctgctgtaatttttctcctcatttacattctagttgcagtttccatcttaattgtatctcaaaataaatagttgtttcaatagatagctaggtagagagctgatcacaggtggttagatgatgggtaatatatatcataaaattaccatgctccccaaagtaatanataaattgccaaaatttcaatgagaatcacaatggggattgtcagtggaaggtggggaaaacttcattttttaaaaaatgtgttgacactgggaaaaaatacaataaagttcctgcatcaggagtagcaaaaaatattatgtaaaagaaaaataattaaaggattagtctttcaaaatttaataacataccataaaaccactgagctaaaaaacatcatgatattggaataaaaagacaaaataaatcaatggaaccccatagggcatctagaaataaatttggggatttaacacatgacaaaggtggcactttaacacccagtgggcaa

SEQ ID NO: 603 - DNA, 661 bp, Homo sapiens
  misc_feature [331]..[331]: Chromosome 4, SNP identification no. = rs4502651
  misc_feature [331]..[331]: allele = t, in linkage disequilibrium with rs10518098, respectively
  misc_feature [331]..[331]: n is a, t, c or g
tctcttattagcaaataccattagtatcattgctaggacttctgtcattagtgtttatctggaggtttgactgggtcaccctgctgcttctttccttgtgtgtcccacagtaaaaggggagaaagagaaaatatcctgctgtaatttttctcctcatttacattctagttgcagtttccatcttaattgtatctcaaaataaatagttgtttcaatagatagctaggtagagagctgatcacaggtggttagatgatgggtaatatatatcataaaattaccatgctccccaaagtaatacataaattgccaaaatttcaatgagaatcanaatggggattgtcagtggaaggtggggaaaacttcattttttaaaaaatgtgttgacactgggaaaaaatacaataaagttcctgcatcaggagtagcaaaaaatattatgtaaaagaaaaataattaaaggattagtctttcaaaatttaataacataccataaaaccactgagctaaaaaacatcatgatattggaataaaaagacaaaataaatcaatggaaccccatagggcatctagaaataaatttggggatttaacacatgacaaaggtggcactttaacacccagtgggcaaagataagttatttaataaaatgtgctagta

SEQ ID NO: 604 - DNA, 661 bp, Homo sapiens
  misc_feature [331]..[331]: Chromosome 4, SNP identification no. = rs4301078
  misc_feature [331]..[331]: allele = a, in linkage disequilibrium with rs10518098, respectively
  misc_feature [331]..[331]: n is a, t, c or g
gtgtttatctggaggtttgactgggtcaccctgctgcttctttccttgtgtgtcccacagtaaaaggggagaaagagaaaatatcctgctgtaatttttctcctcatttacattctagttgcagtttccatcttaattgtatctcaaaataaatagttgtttcaatagatagctaggtagagagctgatcacaggtggttagatgatgggtaatatatatcataaaattaccatgctccccaaagtaatacataaattgccaaaatttcaatgagaatcacaatggggattgtcagtggaaggtggggaaaacttcattttttaaaaaatntgttgacactgggaaaaaatacaataaagttcctgcatcaggagtagcaaaaaatattatgtaaaagaaaaataattaaaggattagtctttcaaaatttaataacataccataaaaccactgagctaaaaaacatcatgatattggaataaaaagacaaaataaatcaatggaaccccatagggcatctagaaataaatttggggatttaacacatgacaaaggtggcactttaacacccagtgggcaaagataagttatttaataaaatgtgctagtataataatctatgaattagggaaaaaataaacttggacactatctcatact

SEQ ID NO: 605 - DNA, 661 bp, Homo sapiens
  misc_feature [331]..[331]: Chromosome 4, SNP identification no. = rs7700096
  misc_feature [331]..[331]: allele = g, in linkage disequilibrium with rs10518098, respectively
  misc_feature [331]..[331]: n is a, t, c or g
gtaatacataaattgccaaaatttcaatgagaatcacaatggggattgtcagtggaaggtggggaaaacttcattttttaaaaaatgtgttgacactgggaaaaaatacaataaagttcctgcatcaggagtagcaaaaaatattatgtaaaagaaaaataattaaaggattagtctttcaaaatttaataacataccataaaaccactgagctaaaaaacatcatgatattggaataaaaagacaaaataaatcaatggaaccccatagggcatctagaaataaatttggggatttaacacatgacaaaggtggcactttaacacccagngggcaaagataagttatttaataaaatgtgctagtataataatctatgaattagggaaaaaataaacttggacactatctcatactatgtaagaaataaattatagatggctaaagttaatatacacgttctttttaataatgataataatccaaaagatattagagaaatatagcataattggcatatactttttaaaagtttgatgtaacaaaaggtatcatgaataaaagtgtgagttaaacaataggttagtagctatacttaaaatttatgcaacaaaaaatagcacatattgttaaaagagcaccatcaaactaattggtcacc

SEQ ID NO: 606 - DNA, 661 bp, Homo sapiens
  misc_feature [331]..[331]: Chromosome 4, SNP identification no. = rs7654146
  misc_feature [331]..[331]: allele = c, in linkage disequilibrium with rs10518098, respectively
  misc_feature [331]..[331]: n is a, t, c or g
taaaggattagtctttcaaaatttaataacataccataaaaccactgagctaaaaaacatcatgatattggaataaaaagacaaaataaatcaatggaaccccatagggcatctagaaataaatttggggatttaacacatgacaaaggtggcactttaacacccagtgggcaaagataagttatttaataaaatgtgctagtataataatctatgaattagggaaaaaataaacttggacactatctcatactatgtaagaaataaattatagatggctaaagttaatatacacgttctttttaataatgataataatccaaaagatatnagagaaatatagcataattggcatatactttttaaaagtttgatgtaacaaaaggtatcatgaataaaagtgtgagttaaacaataggttagtagctatacttaaaatttatgcaacaaaaaatagcacatattgttaaaagagcaccatcaaactaattggtcacctcttgagaaaaacaagtcattatcttgaaaaactggtaaataacttaacagactcaaacatttatcttactttcctatgtgaattgaactactgaggcgagtatctcgttattttagctaacaaagcataatgacagaagtagactatcacttgtttacaatc

SEQ ID NO: 607 - DNA, 661 bp, Homo sapiens
  misc_feature [331]..[331]: Chromosome 4, SNP identification no. = rs2056022
  misc_feature [331]..[331]: allele = g, in linkage disequilibrium with rs10518098, respectively
  misc_feature [331]..[331]: n is a, t, c or g
aaattatagatggctaaagttaatatacacgttctttttaataatgataataatccaaaagatattagagaaatatagcataattggcatatactttttaaaagtttgatgtaacaaaaggtatcatgaataaaagtgtgagttaaacaataggttagtagctatacttaaaatttatgcaacaaaaaatagcacatattgttaaaagagcaccatcaaactaattggtcacctcttgagaaaaacaagtcattatcttgaaaaactggtaaataacttaacagactcaaacatttatcttactttcctatgtgaattgaactactgaggngagtatctcgttattttagctaacaaagcataatgacagaagtagactatcacttgtttacaatctccagtgaatctaggcattgagaatcaatggttgctaacattaaaaaggagataaaagagacagtatatgcctcctgatgaaagaatgagaccccacttataatcttgccaaaaggaacaagtagctgaagtcagatttctgtattcagttgccaatttgtagaatatgcagaaaagaaaataacaatttgaactacatcttaagtaagtagtcagcatagatggaacagattttctggaaagtgagaagatcggatggcctggg

SEQ ID NO: 608 - DNA, 661 bp, Homo sapiens
  misc_feature [331]..[331]: Chromosome 4, SNP identification no. = rs2056023
  misc_feature [331]..[331]: allele = a, in linkage disequilibrium with rs10518098, respectively
  misc_feature [331]..[331]: n is a, t, c or g
tggctaaagttaatatacacgttctttttaataatgataataatccaaaagatattagagaaatatagcataattggcatatactttttaaaagtttgatgtaacaaaaggtatcatgaataaaagtgtgagttaaacaataggttagtagctatacttaaaatttatgcaacaaaaaatagcacatattgttaaaagagcaccatcaaactaattggtcacctcttgagaaaaacaagtcattatcttgaaaaactggtaaataacttaacagactcaaacatttatcttactttcctatgtgaattgaactactgaggcgagtatctcnttattttagctaacaaagcataatgacagaagtagactatcacttgtttacaatctccagtgaatctaggcattgagaatcaatggttgctaacattaaaaaggagataaaagagacagtatatgcctcctgatgaaagaatgagaccccacttataatcttgccaaaaggaacaagtagctgaagtcagatttctgtattcagttgccaatttgtagaatatgcagaaaagaaaataacaatttgaactacatcttaagtaagtagtcagcatagatggaacagattttctggaaagtgagaagatcggatggcctgggttcttcaata

SEQ ID NO: 609 - DNA, 661 bp, Homo sapiens
  misc_feature [331]..[331]: Chromosome 4, SNP identification no. = rs2365795
  misc_feature [331]..[331]: allele = c, in linkage disequilibrium with rs10518098, respectively
  misc_feature [331]..[331]: n is a, t, c or g
tttcctctgtacctcctgagtgtgcctctcaggccccatggctctggaaagcaccacttgaaactacccaaacagatcatccctaagatttttttttttactctaccattcagatatgtaaagatgggaagcccaacactgctctcaaaaacaattgttactatttaaagggagagagagaaataatgtcctaaaatttgcacttgatgaatattaagaaaggcaacatattagaaggacatatgtattagtccattcctactttgctatgaagacatatctgaaactgggtaatttataaagaaatgaggttcaattggctcatggtttngtgggttgtacgggtgtctgcttctggcgaggcctcaggaaacttgcaatcatggcagaaggcaaaggggaagaaaacacgtcttacatggccagcaggagcgagagtgaggggggaggtgccacataccttccaacaaccaggtctcatgagaactccatcacaagacagcaccagggagatggtgctaaacgattaaaaactacccccatgatccaatcacctctctccacatccccactccaacactgggggtcacgattcaatatgagatttgggtggagacacagagccaaaccatattaacatgtttcagtgtctcccccactg

SEQ ID NO: 610 - DNA, 661 bp, Homo sapiens
  misc_feature [331]..[331]: Chromosome 4, SNP identification no. = rs6840004
  misc_feature [331]..[331]: allele = t, in linkage disequilibrium with rs10518098, respectively
  misc_feature [331]..[331]: n is a, t, c or g
attaatcttgtgagcacctgcaggggttaggataggaagttaataaattacttgactaccctttactgaaataacggtatgcaagcaagcatgcatagaggaaaaaaaggaaaaagaaaaataagtaaaatgtattatggttcctgtaataaaggctcaattgcatgtatagcccacatttatttcaatgtttaacattagaagtgtttagggactttatttagaagttggtgatattttctgaccagaaatacgccataggaacttaactcttgtttgtatcaatgaacatatggcaaaattgtctttttgcttaaagttgcagtttccnagaacataccaacaaccttaagtatggacttactgtatgtgtaacaaaaggttctgttaggtcctagtactactacttaagtactagtcattgtttaccttgagaacatgtttgtattgagttctgtatgggtagctatataaaacgatgagatttcttccagtctttgcagtctctttaatgaattacctgtgatgtacatcacatttcagtttaatgcttgtttaataataaagctttttttctttttttttaattatactttaagtgttagggtacatgtgcacaacgtgcaagttagttacatatgtatacatgtgccatgttggt

SEQ ID NO: 611 - DNA, 661 bp, Homo sapiens
  misc_feature [331]..[331]: Chromosome 4, SNP identification no. = rs1121770
  misc_feature [331]..[331]: allele = a, in linkage disequilibrium with rs10518098, respectively
  misc_feature [331]..[331]: n is a, t, c or g
ccattttggagaggttttcgatgctggcaggagattttgtctttaattatatttcctcaacatccaaggactacttcagaagatgtattcaatttttggattggggaggagaggtggagcaagatgacagaatggaaagctccatggattatccctctggcaaggacaccaatttaacaactatctacaaagaaaaaaaacaccttcataacaactgaaaatcaggtgagcactcatatacctggttttaactttatgtcactgaaagaggcactggaaagatagaaaaaaacagtcgtgaattgctgacaccacccttccctactccggnagcagtgggttggtgtgtagagcatctctgggttctgggggagggagaacacagcaattgtgaggcattgaactcagtgttgtcctgttagagcagaaaggaaaatcagaccaaactcagctgacacctgcccaaaaagggagcatttaaaccaccctagccagaggggaatctccaatcccagtagtccaaattttagtgccagaaaacctcaccaccgagggacaaagtactctgggtctctaagtaaacttaaaagtcagtctaggccataaggactgcaacacttaggtgagtcctaggactgatttaggcccagagacagtggac

SEQ ID NO: 612 - DNA, 661 bp, Homo sapiens
  misc_feature [331]..[331]: Chromosome 4, SNP identification no. = rs11940139
  misc_feature [331]..[331]: allele = g, in linkage disequilibrium with rs10518098, respectively
  misc_feature [331]..[331]: n is a, t, c or g
ctcagtgttgtcctgttagagcagaaaggaaaatcagaccaaactcagctgacacctgcccaaaaagggagcatttaaaccaccctagccagaggggaatctccaatcccagtagtccaaattttagtgccagaaaacctcaccaccgagggacaaagtactctgggtctctaagtaaacttaaaagtcagtctaggccataaggactgcaacacttaggtgagtcctaggactgatttaggcccagagacagtggactgagagggcatgtgacctactgtgatgccatgagtcaagaaagtgatggtgccacccctcctgtaactccagncttcacagcttgtggctccaaaagagaccccttccttctgcctaaaaaaggatagggaagagcagggaagactttgtcttgcatcttggataccagctcagccacagcaagatagggcacctaggtcagagtcatgaggaccccattccaggtcctggttcccagatgacatttctagacatgccctgagccagaggggaaccctccgccttgaaggaaaggacccagtcctgccatcattcatcacctactaactgaaaagcccttgggccatgaataaccagcaacgatacacaggtacaatattgagggccttgggtgagcttctga

SEQ ID NO: 613 - DNA, 661 bp, Homo sapiens
  misc_feature [331]..[331]: Chromosome 4, SNP identification no. = rs868028
  misc_feature [331]..[331]: allele = c, in linkage disequilibrium with rs10518098, respectively
  misc_feature [331]..[331]: n is a, t, c or g
catgacgtcgactcgaccgtgagtttggtattctaaagtgagatcaaccaaaggtactttgagacaacacccggttgtagagaagactcgaactcccctacctatggggtaagaagggaagagaaaggtttccgtctcctctgaacggggtatcggtggtggtgtgaaccggtactcctcatgacggtctggtgtgactaaaaaggaattccgggatccatagaattcagtcaaaaaccacataggacagaccggaccctgagtgtgaagtcccgtcactcgagggtagaccgggtcccgtctagggttttacggtaggttctcagtgtangatctcaacccccggggttctcggacagaccacgagataagggtctacgtgtgtccccacactgtcaccttcggtcgttcggagtcttcgagtgggttccgggagttataacatggacacatagcaacgaccaataagtaccgggttcccgaaaagtcaatcatccactacttactaccgtcctgacccaggaaaggaagttccgcctcccaaggggagaccgagtcccgtacagatctttacagtagacccttggtcctggaccttaccccaggagtactgagactggatccacgggatagaacgacaccgactcgaccataggttcta

SEQ ID NO: 614 - DNA, 661 bp, Homo sapiens
  misc_feature [331]..[331]: Chromosome 4, SNP identification no. = rs868026
  misc_feature [331]..[331]: allele = c, in linkage disequilibrium with rs10518098, respectively
  misc_feature [331]..[331]: n is a, t, c or g
gttggtcgtccaccgtttcggtaggtccagacacagaaaaggaagtctcaccgttctaggggtccgggacccacctaggtcttcatgggagtccctcagtccctgatcttatttttaggaatctccagatgtaccacaggataacatgacgtcgactcgaccgtgagtttggtattctaaagtgagatcaaccaaaggtactttgagacaacacccggttgtagagaagactcgaactcccctacctatggggtaagaagggaagagaaaggtttccgtctcctctgaacggggtatcggtggtggtgtgaaccggtactcctcatgacgntctggtgtgactaaaaaggaattccgggatccatagaattcagtcaaaaaccacataggacagaccggaccctgagtgtgaagtcccgtcactcgagggtagaccgggtcccgtctagggttttacggtaggttctcagtgtaggatctcaacccccggggttctcggacagaccacgagataagggtctacgtgtgtccccacactgtcaccttcggtcgttcggagtcttcgagtgggttccgggagttataacatggacacatagcaacgaccaataagtaccgggttcccgaaaagtcaatcatccactacttactaccgtcctga

SEQ ID NO: 615 - DNA, 661 bp, Homo sapiens
  misc_feature [331]..[331]: Chromosome 4, SNP identification no. = rs7673208
  misc_feature [331]..[331]: allele = c, in linkage disequilibrium with rs10518098, respectively
  misc_feature [331]..[331]: n is a, t, c or g
ttgtgtcactccacccccagctccaggtgcctcagaacagagagatgcagagactctgcatgtttgggagaaagtaagagaagagtacaagaacctctgcctgttaatccagagacttctccccgatcttgtccaggaccatcaaggtagtacttctacaagcctgcatcaaccacagtgttactgggcttgggatgccccctaacacagaaacagctcagatcacaacacacgagtcttttcaaatatctggaaagccttttcaagaaagacagctacaaacaagctaagactgtgaagactacaataaatacctaacccttcaatgccnacataccaagaacatctgctagcaccatccaggaaaatatgaccttaccaaatgaagtaaatagagtaccaaggaacaatcctggagaaacagagatatataacctttcagacaaataattcaaaatagctgtgttagggaaactcaaaattcaagaaaacacagagaaggaattcagaattctatcagataaatttaacaaagagattaaaataattaaaaagaattaagcagaaatgaaattctggagctaaaaaaaaatgcagttgacatgctgaagaatgtatcagagtcctttagtagcagaatttgatcaagcaaaagaaaaag

SEQ ID NO: 616 - DNA, 661 bp, Homo sapiens
  misc_feature [331]..[331]: Chromosome 4, SNP identification no. = rs4694467
  misc_feature [331]..[331]: allele = a, in linkage disequilibrium with rs10518098, respectively
  misc_feature [331]..[331]: n is a, t, c or g
gaagtttatagaacactaagtagatttaacccaactacctcaaggcatttaataatcaaattcccaaaggccacatataaagagaggatcctaaaagcagcaagagaaaagaaataaataacatacaaatggcactccaacacgtctggaagcagacttttcagtggaaaccttacaggccaggagagagtgacatgacatatttaaagtgctgaatgaagaaaaaaaacaaaaaaccttttaccatagaatactgtatctggcaaaaatatccttcaaacataacggagaaataaaaactttcctagaaaaacaaaacctgggtatttcntcaacaccagacctgtcttataagaaatgctaaggtgagtatttcaatcagaaagaaaaggccattaatgagcaataaatattcacctgatggtaataaaacttacggtaagaataagttcacagacaaaaaagaatattataacactgcaattgtgttgcgtaagctagtcttttcctaagtaaaaagactaaatgatgaaccaatcaaaaataataactgcaaattttcaagacatagtacaataagatataaatagaaacagcaaaatattagaaagctggaggatgaagctaaggtgagtttttattagttttctttttgcttgtt

SEQ ID NO: 617 - DNA, 661 bp, Homo sapiens
  misc_feature [331]..[331]: Chromosome 4, SNP identification no. = rs4694468
  misc_feature [331]..[331]: allele = c, in linkage disequilibrium with rs10518098, respectively
  misc_feature [331]..[331]: n is a, t, c or g
actttgatagttgtctggccttggcttcctcctaccttttcagattttgataaatcaattgagttattttgtgggaatataatatttttcttggtaatcataagggcattacaaggctgtccaataacaggaagaaaacagtattactgattttttttccatctggcacatcttttagaaagttagatttaattaaccagggctattagcaaaatttttgattttttctttctttctctctttctttccctttatccctacttagatatttctctcagatctaaggttattttctccaaatcctccttatgagacttcttcccataatctnccttaaagcttttcctccctaattccaaagataagttgccagccatccttgaatcaggccctcatcatgtttttagatcccatcctttttttttctaaaaagtatgttaggtattatgatttgtgggtctgaaagacaattctgcccactaaaaaatctgatctacctcaaaagattgggtttccccaaatcataaatcttgcccataatcaataattactcattatttctagaatattataattaaaaacacaagtgaagcagggagaaatccagaatctctaatgcatttcccctgtcctttcattccacaatgctccaactcagatt

SEQ ID NO: 618 - DNA, 661 bp, Homo sapiens
  misc_feature [331]..[331]: Chromosome 4, SNP identification no. = rs1398982
  misc_feature [331]..[331]: allele = c, in linkage disequilibrium with rs10518098, respectively
  misc_feature [331]..[331]: n is a, t, c or g
ttctccaaatcctccttatgagacttcttcccataatctaccttaaagcttttcctccctaattccaaagataagttgccagccatccttgaatcaggccctcatcatgtttttagatcccatcctttttttttctaaaaagtatgttaggtattatgatttgtgggtctgaaagacaattctgcccactaaaaaatctgatctacctcaaaagattgggtttccccaaatcataaatcttgcccataatcaataattactcattatttctagaatattataattaaaaacacaagtgaagcagggagaaatccagaatctctaatgcatntcccctgtcctttcattccacaatgctccaactcagattagagtattaagtcttaaagtgatgtttgtagtcaaatcatttacacagaggatactttatgcagcatctccatttatattcaaacagttatcagcttagggaacattatccaggaagtcatactccataaatctgtatgctctaagcttacttaaataatcctacacaattaggtgcattatgctaaaagaaaaccatagaaagattcacttgctgaaaaatatcttcaaactgtctgtctggaggtctaccattagtgcatttcctgggagatttttttccagcttttat

SEQ ID NO: 619 - DNA, 661 bp, Homo sapiens
  misc_feature [331]..[331]: Chromosome 4, SNP identification no. = rs10938009
  misc_feature [331]..[331]: allele = a, in linkage disequilibrium with rs10518098, respectively
  misc_feature [331]..[331]: n is a, t, c or g
tctaagcttacttaaataatcctacacaattaggtgcattatgctaaaagaaaaccatagaaagattcacttgctgaaaaatatcttcaaactgtctgtctggaggtctaccattagtgcatttcctgggagatttttttccagcttttattttatatttgggggtaaatctgcagggctttgacatgggtgaattgtgtgatgctgaggattgagatatgattgatcttgtcacccaggtagtaagcatagtacacaataggtactttttcaatccttgtcctcctctccactctacttgtccccattgtctattgttctcatccttatntccatgtataaacaatgtttagcttccacttatatataagaatatgtggtatttggttttctgcattcatttgcttaggataatggcctccagatgcatccatgttgctgcaaagaacatgatttcattcttttttaatgcctgtgtagtgttccattgtgtatatgtaccacattttctttatccaatccaccattgatgggtacctaggttgattccacatttttgctactgtgaatagcgctgcaatgaacatgcaagtgcatgtgtatttttggtagaatgatttattttcctttgtgtatacccagtaatggaattgctgggttg

SEQ ID NO: 620 - DNA, 661 bp, Homo sapiens
  misc_feature [331]..[331]: Chromosome 4, SNP identification no. = rs996154
  misc_feature [331]..[331]: allele = a, in linkage disequilibrium with rs10518098, respectively
  misc_feature [331]..[331]: n is a, t, c or g
cagaagttataactgaatacatccatcaaaatttcacattaattagtagactaaataggtctgtatgaatttttatgtacctaagatcctgaagtgtaacttccaagactgattcatctagacttcaccccgtactctacgtacataaaattatatttcaaaggatcaatttataccataaacagtaatgtagatctatagttattattttaaagacttctgagtatctttttgttagatcactagtaattaagtacaaaaaaaaaaattgttttctccttctacatgacttttcttcagaacaatcagtgggatccgaccgtactttacncgtcttgatctcgagtcctgaggagtacatcaggtattaggataggtggtgtaaaggacctgaaaacacaattaatgacggaagtacgtaacaaacaaattgatttataagtagatgtcatagtgtttgaagtaagtacaagtgttattgaatattctgtatataaaatactagatttattttaacggtataaaagttcgtaataacctactgaagttcactaactaaatctaaataaacgtccaagtaaggttacgtacgaaaatttagtatgtgtgaacttcttctaaccttttacacatgtggtgtcgagacgtcaagtaagtgaga

SEQ ID NO: 621 - DNA, 661 bp, Homo sapiens
  misc_feature [331]..[331]: Chromosome 4, SNP identification no. = rs996153
  misc_feature [331]..[331]: allele = t, in linkage disequilibrium with rs10518098, respectively
  misc_feature [331]..[331]: n is a, t, c or g
agacgggagaaacgaaaaagtgtatatataaattatttgtacagaagttataactgaatacatccatcaaaatttcacattaattagtagactaaataggtctgtatgaatttttatgtacctaagatcctgaagtgtaacttccaagactgattcatctagacttcaccccgtactctacgtacataaaattatatttcaaaggatcaatttataccataaacagtaatgtagatctatagttattattttaaagacttctgagtatctttttgttagatcactagtaattaagtacaaaaaaaaaaattgttttctccttctacatganttttcttcagaacaatcagtgggatccgaccgtactttactcgtcttgatctcgagtcctgaggagtacatcaggtattaggataggtggtgtaaaggacctgaaaacacaattaatgacggaagtacgtaacaaacaaattgatttataagtagatgtcatagtgtttgaagtaagtacaagtgttattgaatattctgtatataaaatactagatttattttaacggtataaaagttcgtaataacctactgaagttcactaactaaatctaaataaacgtccaagtaaggttacgtacgaaaatttagtatgtgtgaacttcttcta

SEQ ID NO: 622 - DNA, 661 bp, Homo sapiens
  misc_feature [331]..[331]: Chromosome 4, SNP identification no. = rs2365797
  misc_feature [331]..[331]: allele = t, in linkage disequilibrium with rs10518098, respectively
  misc_feature [331]..[331]: n is a, t, c or g
aattaaatgtcagaaaaaaattacattttaaaataatgtatgagtaactattcagtacaaataataaaacattttctctttctgaaaaatactattattgattttaaaatgtatgccttccgtagcactgatgcataactctaagaaaaatgtagtaatttgtggacaaaactacctatttaatttattttgacagtatgttgtttatagagaaatattctaattcaccacagtgaattttgctactttgactttcataagcaaacatttataggcattcttaaaatgcaaataaatggctattttagtcactattcctgcactctttcgnttattctagagaaaagtgggctaaactattttaaccatgactgagaatagctgcttgcagacgctcactcagaattctaacattccttcctctatgtagtcattatttactacactgagtctctttcacgagcccaaaattccaaatctatgtactcctaaaattgcaacttactgatttaggtccagaagacatgtatggatagtatacaactatgcatttgctgcatagtgatgggtcataatgaaatactagcaatttagcatattgtttgtaattattactggattgtgtaagttctgtttgagcctcataattttattggcctta

SEQ ID NO: 623 - DNA, 661 bp, Homo sapiens
  misc_feature [331]..[331]: Chromosome 4, SNP identification no. = rs1018283
  misc_feature [331]..[331]: allele = a, in linkage disequilibrium with rs10518098, respectively
  misc_feature [331]..[331]: n is a, t, c or g
actaggtgaagggggttctactactctagtactaagaggtgtaaatagtgtaagaatagaagagagaagtaattaggtagaactcggttcacaggttgggaccaggtgagttagtacaggtccttacgtcttaggataccatttttacactcataaccatcgacgtggaagtcactctcaaatttctttatacctacacttgacctacctacaaagtattgtaggagatttaaaaggtacttctgtggtgtcataggaatatattttcggaaatctttcaggataagtgttttaccttaacttcttttaacttcattttaataattttacncattccggttattttaatactccgagtttgtcttgaatgtgttaggtcattattaatgtttgttatacgatttaacgatcataaagtaatactgggtagtgatacgtcgtttacgtatcaacatatgataggtatgtacagaagacctggatttagtcattcaacgttaaaatcctcatgtatctaaaccttaaaacccgagcactttctctgagtcacatcatttattactgatgtatctccttccttacaatcttaagactcactcgcagacgttcgtcgataagagtcagtaccaattttatcaaatcgggtgaaaagagatcttat

SEQ ID NO: 624 - DNA, 661 bp, Homo sapiens
  misc_feature [331]..[331]: Chromosome 4, SNP identification no. = rs10805048
  misc_feature [331]..[331]: allele = t, in linkage disequilibrium with rs10518098, respectively
  misc_feature [331]..[331]: n is a, t, c or g
tgcatttgctgcatagtgatgggtcataatgaaatactagcaatttagcatattgtttgtaattattactggattgtgtaagttctgtttgagcctcataattttattggccttacgcattttaataattttacttcaattttcttcaattccattttgtgaataggactttctaaaggcttttatataaggatactgtggtgtcttcatggaaaatttagaggatgttatgaaacatccatccagttcacatccatatttctttaaactctcactgaaggtgcagctaccaatactcacatttttaccataggattctgcattcctgganatgattgagtggaccagggttggacacttggctcaagatggattaatgaagagagaagataagaatgtgataaatgtggagaatcatgatctcatcatcttgggggaagtggatcaggaaaataaaaggaagtaaaagagaaagaaaaagaaagctgatctgcaaacaaacatgaatgtaccagatgcctggtgaatagcaaaaagataaaacagaagcagattctggctgtggattcttatgttttgcaaacttttcttaggtccctcggcatttctgaattaaggtttccatgagacacctcagtgtccttataaaaaggcacttttt

SEQ ID NO: 625 - DNA, 661 bp, Homo sapiens
  misc_feature [331]..[331]: Chromosome 4, SNP identification no. = rs957047
  misc_feature [331]..[331]: allele = a, in linkage disequilibrium with rs10518098, respectively
  misc_feature [331]..[331]: n is a, t, c or g
aaagagttgtctaacgtctctctctatcatggtatgtcattgttcttttgtcgagtcctcagtctcatacaccttaaccaaagagtgtaacaaagaccgaggtatcaagactcgaaccgtggtgaaaagccccacaatcaaatatgaaacagttttacatgtacctaatctatttagattctaaagaaagttgaaatcgtaataggtatagtcacttgttttaatagtaattcaggatacataacttacgttatgacaccttcttaaaccccttattttaatatgtgaactaggttcgacttgtcttgtcgtctctatttcgtgaacctgnagagagactcataagaaacgtatggactactctagtggaggagtcctgtctcattttggtctagtgtccacttcttcatactcgagtctctctgacttacaccaactgtgtccgtctccgtaccctccaaggaatttaacaaccgttaggacaaacttccggatttccaattactgtatcataagtggactcttaagaaggtacaagaaaccagacctttaaagtggatactcagtggggatgtaattatggatgtgtaaaaatactaagaccaaagttcgaagagttactattcgtaagtatttttagtggataagttggtgtctttga

SEQ ID NO: 626 - DNA, 661 bp, Homo sapiens
  misc_feature [331]..[331]: Chromosome 4, SNP identification no. = rs957046
  misc_feature [331]..[331]: allele = c, in linkage disequilibrium with rs10518098, respectively
  misc_feature [331]..[331]: n is a, t, c or g
catcatacctttttacgtttcaattacttctgataaattatagacattaatgtagaataaatgagaattccaaactacctgtaaatgaaatctagagactatagaggtaaggtgtatcttatgttgaacagtgaagtgaaatcaaacaaaagtatggtgtatgacttaagttgactaacgtctctctctatcatggtatgtcattactcttttgtcgagtcctcagtcccatataccttaaccaaagagttgtctaacgtctctctctatcatggtatgtcattgttcttttgtcgagtcctcagtctcatacaccttaaccaaagagtgnaacaaagaccgaggtatcaagactcgaaccgtggtgaaaagccccacaatcaaatatgaaacagttttacatgtacctaatctatttagattctaaagaaagttgaaatcgtaataggtatagtcacttgttttaatagtaattcaggatacataacttacgttatgacaccttcttaaaccccttattttaatatgtgaactaggttcgacttgtcttgtcgtctctatttcgtgaacctggagagagactcataagaaacgtatggactactctagtggaggagtcctgtctcattttggtctagtgtccacttcttcatactcgagt

SEQ ID NO: 627 - DNA, 661 bp, Homo sapiens
  misc_feature [331]..[331]: Chromosome 4, SNP identification no. = rs957045
  misc_feature [331]..[331]: allele = a, in linkage disequilibrium with rs10518098, respectively
  misc_feature [331]..[331]: n is a, t, c or g
tctaggaactccttaattcctatttacacatcatacctttttacgtttcaattacttctgataaattatagacattaatgtagaataaatgagaattccaaactacctgtaaatgaaatctagagactatagaggtaaggtgtatcttatgttgaacagtgaagtgaaatcaaacaaaagtatggtgtatgacttaagttgactaacgtctctctctatcatggtatgtcattactcttttgtcgagtcctcagtcccatataccttaaccaaagagttgtctaacgtctctctctatcatggtatgtcattgttcttttgtcgagtcctnagtctcatacaccttaaccaaagagtgtaacaaagaccgaggtatcaagactcgaaccgtggtgaaaagccccacaatcaaatatgaaacagttttacatgtacctaatctatttagattctaaagaaagttgaaatcgtaataggtatagtcacttgttttaatagtaattcaggatacataacttacgttatgacaccttcttaaaccccttattttaatatgtgaactaggttcgacttgtcttgtcgtctctatttcgtgaacctggagagagactcataagaaacgtatggactactctagtggaggagtcctgtctcattttgg

SEQ ID NO: 628 - DNA, 661 bp, Homo sapiens
  misc_feature [331]..[331]: Chromosome 4, SNP identification no. = rs10008822
  misc_feature [331]..[331]: allele = a, in linkage disequilibrium with rs10518098, respectively
  misc_feature [331]..[331]: n is a, t, c or g
gcacatgtatccacaaacttaaaataaattttaaaaatgtatccttagaaagtctaattatttatataaattatatatatatatataagttaagaaaaacatacatttaggaaaaccatattttataattccaaatgaaacttttaggtgagtgggggaccgtggaaaaaagatgtgaatatctgagatcgaaaagaatcactgaaatcatgtacacactctgttttcttgcctagtggttgctttctccatcagagacagaaagaatcaaatgcagacatataagaaccctgcatggactgtgttcacctgaacttaccaactcaaggcnaaatatactctaatattaaaattacatttcaaagtatatttaattttgctatcccattattatctctttgtagctcaaatgagaatgacactgttatgagatctctggcgtgtcgattattctagccagaaacttctgtcactgcagcgcctttgctcgagttcttgtcctgcatccaggaagaatgaggtatgcagacaagtgaaggggaagaagaagagttttatttagcattaaaacaattcagaggagtgggcagctcctctctttaggcaggccatccagtcgagtggtcagctctctgcagagaggaggccctggagaggacag

SEQ ID NO: 629 - DNA, 661 bp, Homo sapiens
  misc_feature [331]..[331]: Chromosome 4, SNP identification no. = rs4547769
  misc_feature [331]..[331]: allele = a, in linkage disequilibrium with rs10518098, respectively
  misc_feature [331]..[331]: n is a, t, c or g
gaggtatcattcaagttgagatttgggtggggacgcagccaaaccatattaccaggagctaaatgatgagaacacatggacacatagaggtgaacaccatacaatggggcctattggagggtggagggtgggtgaagaaagaggatcaggaaaattgactaatgggtgctagacttactacctggatgatgaaataatctgtacaacaaatccccatgatacatgtttacctctgtaacaaaactgtacatgtacccctggacttaaaagttaaaaaaaaatttctccttggcctagactgttatgtatcagatagagtgaaccagcttgngttgtctcctaataagagcaaggaaataaatttttgtcaagcattttggtctactgtctttctcctcgcttggctagcatgcccacttgcactatctattttaacacattttcttctctgcagcaagtttttatcttttaaatattttcgatgctgctagacaagaaatacatagcattttaaattctattctgtattattggtgagactgaacacttatattgtgtttattagccattattacttattagctcaataattatttatacattttagacatatcatttaggatactatttctttgctaagtcaacttataagagatttgta

SEQ ID NO: 630 - DNA, 661 bp, Homo sapiens
  misc_feature [331]..[331]: Chromosome 4, SNP identification no. = rs7674709
  misc_feature [331]..[331]: allele = t, in linkage disequilibrium with rs10518098, respectively
  misc_feature [331]..[331]: n is a, t, c or g
gacccacaatgggcagctcctcttcatagccagggagtcctgacaagtgttcagcttttagcggagacagtagctcctctttatagctggttgtcccattgtttcttcaactcttagcagtgagggtaatttctctctgtggctgattgtcccatcatttcctcagctctcagcagagcgagtagctcctctcttagtcaggttgtcccaatgagtgtccagctttctgcagagaggatagctcctccctgcagctggtcatcttgttgtctctttgagtctgactgagtctggggcttttatgggcctcagaagggaggaagtatacacngattggtccatgggcagccatgggagggcctggaaaaagcaccacaagtttctactctggtccacaaaaccagcagctttgcctctaggcttcagaccctccccagcttgaaggtggggcttcactggggacatctgcccttccacccaggagcctgtctgcctcctgctgccattcataagctgccctcagccctgcctcagcctctcttccatgatgttggcacccaaagtctggagggggctgaggtggcaggaggctggcatgtcagtgctgccctgagcatgcgcactcccgccgggatgcaagagtggctgggctcagtctcaa

SEQ ID NO: 631 - DNA, 661 bp, Homo sapiens
  misc_feature [331]..[331]: Chromosome 4, SNP identification no. = rs10938010
  misc_feature [331]..[331]: allele = a, in linkage disequilibrium with rs10518098, respectively
  misc_feature [331]..[331]: n is a, t, c or g
aggctatgggactagctgagcagtcagggcacacaaggccttgttatcacctagtattatttatattatctaaagtctttctcctttggtaatctctttcttttggcattttgaatgtgttctcaatccctttaaaaagaatcaaatgattagtgagtacctgcaaaagaaatagttacccctgattgacgcaaatttccaaaacaggtatattttatatatctttctattcccttcacacatgaatgaacacttgactgaaaataaaattgtatatcatcatcataaattttctctcagctttatattttcttatatttagcactacagngggttattcaaagtgagaatgacttctgcaacatagctacctatttttttaaatcatttttgttttttaagtggtatcctgggtgagattttttttaatttcaaggatggtgctttcatcaattttaataagaatttgaataatttttcaatcttcaggctcaaggttgttgtttatatgtttgttttagtcaaaaagtctttctcatgtcatatgtcattattttggcttcagcttttttctcacatcttctttggcagtacttccttccgagagttcatctttgttttatgttataattttgttcaatcaattctataattttctccc

SEQ ID NO: 632 - DNA, 661 bp, Homo sapiens
  misc_feature [331]..[331]: Chromosome 4, SNP identification no. = rs4694469
  misc_feature [331]..[331]: allele = c, in linkage disequilibrium with rs10518098, respectively
  misc_feature [331]..[331]: n is a, t, c or g
aagtacttttataataaattaattaagctaaaataagtgacatttattttgaataattccagaattgttttcatgaagtcatttaccctagggcatatcttcaattagggatatattaacaaaaattattttacagactttaggggaaaaatagagtgaatgaacatgtgaaaattgttcacaaatgaaataaaatcataaatcgattagcttttatcttttcgaatgcaccattacataaagcacgtatttactttattcaattatgtttcaaaataatgttgatattatttcctataaagacaaatataacgagtattttgaaaatganagggtatgactcacataaatgtgtcttcctctgtgcaacccccaatttcccagagcatccaagtggattagctatgacccaggaaggcagcagcagcatgtttaaaagtgaccattggttatttagttaatgtaaaattatattggaagtgctcttctctcactgactccattaccttggcaaaatatataactgatgctttctatcaatgctcatgtacttgtcctgccgattaattccattcatattcaaagtagtttcagccatgctccatttcaatcgattttatctgcatggcacactggtcacagagtggtcacattgtacagc

SEQ ID NO: 633 - DNA, 661 bp, Homo sapiens
  misc_feature [331]..[331]: Chromosome 4, SNP identification no. = rs7662481
  misc_feature [331]..[331]: allele = g, in linkage disequilibrium with rs10518098, respectively
  misc_feature [331]..[331]: n is a, t, c or g
gtaacattttggttaaatataaacatataaatcatttcatgttttcattttgtttctaagggaatattcattttaaataaaatgtattctgcatttttaaattattttctagaaagtgtttttggtaataaaagctcattttgtttcagagaatggagactgattcaagtttcctggagaaatggagcttattgtaaggctgcacacacccatcataagggagatgggcatcagaggaaaagaagtaatattggttattcactatccaattgcttttctttcccccagcagcaagaagagttcagggaactgtagtatttcttcattaacntgatgctggagaccaagaggatattgatctccaattgaagtcattaggagtatctttagttttaaatctaagaaaattatcatcctttgaaatattattaatatattttaaccagactttcaaatacagattaggcaatattgctccagagacagaaactactgtgaatggctttaattgaagataggtggggataatttcaatgtatgactttctgggtaattaaggcagagtagtactgggtgaggggaaagagggtgtttagggaaagatgcttcatactatcagtcggcttctacagctgtctttcttacacatatgtgcataaga

SEQ ID NO: 634 - DNA, 661 bp, Homo sapiens
  misc_feature [331]..[331]: Chromosome 4, SNP identification no. = rs884511
  misc_feature [331]..[331]: allele = a, in linkage disequilibrium with rs10518098, respectively
  misc_feature [331]..[331]: n is a, t, c or g
gatgctttgacttgccttagacaacacttctcacccatattgaaacactctccttgctaatggagaagaatacaatcccaaggccatagaccgttttgtttgacatagtcttatctctctaatgaaaataaataaagaaaaactattttgccactgattttagcaatttttttaactgcatgttatctaaaaatgtatcaacacaatagaaataagaacatgaggtttgatattgacttacctttcagattccttacacacctcagttgctaagaagagccagtctcaggtgcacctgcataaacaagaggggaggcaacatggagccacntctataccttcgtggatgcttaatcttgtgcctattttttcactacctgtgtattaatttattttggctgtggtaacaaattaccacaaacttggtgccactgaaaaatagaaatttattcccttacagttctagagtctagatgccccaaatcaaggtgtggtagggctgtgctccctgcagaggctgcagtagagaatctattcattgcctcttccagtttctcctagccaataatattctgtgacttgtaggcacaccatttcagtctccaaggacagcatcttcaaatttctctccgctctgttttcatactgtcttctcttctgt

SEQ ID NO: 635 - DNA, 661 bp, Homo sapiens
  misc_feature [331]..[331]: Chromosome 4, SNP identification no. = rs9685357
  misc_feature [331]..[331]: allele = c, in linkage disequilibrium with rs10518098, respectively
  misc_feature [331]..[331]: n is a, t, c or g
tcttgctctgcatccatttattaagtcacatgtggttgcattggagctcacccagataattcaagataacctccccgtctcaaaattcttaatttagcctacggccataccaccctgaacaagcctgatctcgtcaaaattattaatataatcacatctacaaatatcttttttcttgccatataagatagtattcacaggttccagggtttaagacatggaaatattttgagaagccattttccagtcaaccaaaacttgtttgttggttaacaagtaaaaccaagtatatataacctcagctgagtctaaattccttctctcaaacttncttaagcccagacccatctttattacctagtccagctcagaaacacacaaagtatctcgagaagaccccaagagtcaagtactgctgagtagacacagggcaaatgactcacacactctgccttgtgagagaaatataatcttcacttaacctatttaacatttttttcatcaatctgtaataaaactttgacagtactattcatcttcatttccattttaatgtttttgaaatcagaatacgacttttaatcgacgtgtacattttctgtggtagttttacaacccacactgcccaagcaaaagttgtaattaaattgattatgcataa

SEQ ID NO: 636 - DNA, 661 bp, Homo sapiens
  misc_feature [331]..[331]: Chromosome 4, SNP identification no. = rs10029245
  misc_feature [331]..[331]: allele = c, in linkage disequilibrium with rs10518098, respectively
  misc_feature [331]..[331]: n is a, t, c or g
aaaaggaaacagaaattttggaaattgtgaataattatttttaagacgcatgcttaaacaatctaaagactgttatttgttgcaaatattttggtctaaaacattcttcaaataattctgaataattgattgatataatagcagtatggagatgaatgtatacaaaagatgttataagagaattgctgtaactgctaatatattgattcatcaaagataaagcctttcttctaatgaatatatagtatgtaaatgatgatttacagtaattttttaaaagtagctacaaagataggatttcacttccttataataatttaactaaaatggnaaaaagtctaactgcagccaggatataacacttttcacgtgttctccactcttccatcaccttgaatcccacccatgcactgagaagaaccacatagaagtctgtcttgcatttggagactggaaattggaatctgcttcagtgaaagggtatatataaaaagaaattaggtgcataaaagttaaaagttaaatataatcctgatctttcatgaagattaagaaatcaaaacctggaaagacacattcagttactgtccaaaaattgaacaggtcattgttaaatgacccagtaccacaccttcctttctcactaatgcaaatctagaag

SEQ ID NO: 637 - DNA, 661 bp, Homo sapiens
  misc_feature [331]..[331]: Chromosome 4, SNP identification no. = rs10938012
  misc_feature [331]..[331]: allele = g, in linkage disequilibrium with rs10518098, respectively
  misc_feature [331]..[331]: n is a, t, c or g
catcactttttcccttctcaatgtgtgacccctctttccttccagttgcttgggttaaagctggaagtctccctgattcatctctttctcacatcccacgtccaatacatcagaaaacctaaccagttttaacttaaaaatatattataattggactactcactaccttcagaattacctacccattttggtatactcttgtttttcacctcaactattttaataaccttctaaccagcctacgtatttcaacctttgccctgctatacatttgcccagaagcttcagtgatccttttaaagcaagatgccggatcatcttactcctctgnttaaaatcctcttgaggttgttccatctccttcagagtaaaaccatatccttaccgtggaatataaggacttatgtgatccacccctccctcatccctctctctgtctttctcttttccctaccaatttatcctcctacccatttccacagccatactaacatacgtgctattttccatacacacgaaagcattttttttttattattatactttaagttttagggtacatgtgcacaatgtgcaggtttcttacatatgtatacatgtgccatgttggtgtgctgaacccattaactcatcatttacattagggatatctcctaatgct

SEQ ID NO: 638 - DNA, 661 bp, Homo sapiens
  misc_feature [331]..[331]: Chromosome 4, SNP identification no. = rs4694120
  misc_feature [331]..[331]: allele = c, in linkage disequilibrium with rs10518098, respectively
  misc_feature [331]..[331]: n is a, t, c or g
tactcaagactaccactatgtttattgactatctcttcccactttaatgtaagctcttgaaagtaggaacattatctctactactcctggaatatagtaggtgctcaaatgctttcatttaatgaatgaatattgtatattgaaatttggatgataaaataattttctaaatagaaacttgaaccacagtttatattcttttttagaaatcatattcaaggaaggtaaagattagagggagaggggtttaatttttttttattcagtcataataaatggaacaaactatttttgaggctaatatttcaggctacatgatatattttcttgngttttttgctttgatgttaaaaatagtcatgggaagagaaaagttttaaaaagtcaaaatgattcttatattcttacatattatgattgaaggccagtcaaaagagcagtgtgaggaaagtaaaagtatctcaaagctctacaaaagctttcaaactcaactggtcacatgaacaagagagagagagaacataagtgagtgaaatagtccaattaaaaaaacaccaggatctagtgggaatatgtcaaactggaggcttcacactcagtctaaagatagtattccatttttaaaaatagtctgtaagtaaaaataaatatctgcttatac

SEQ ID NO: 639 - DNA, 661 bp, Homo sapiens
  misc_feature [331]..[331]: Chromosome 4, SNP identification no. = rs10518099
  misc_feature [331]..[331]: allele = c, in linkage disequilibrium with rs10518098, respectively
  misc_feature [331]..[331]: n is a, t, c or g
agtccaattaaaaaaacaccaggatctagtgggaatatgtcaaactggaggcttcacactcagtctaaagatagtattccatttttaaaaatagtctgtaagtaaaaataaatatctgcttatacatatgtctcaaaagcctgtcagtttgtatccctattgcaggaagaaaaatatcagaagaaacttcagatgtcacagagctacaatatttcttactcagtgtatgagaactcttcatttgaaaatcaagagtgaatctttaaaaggttgaatgcagattgttcgctccagaaatccacctgcagatgagaatagaatactactctanggctaaatgaaaagaacaacttaaaataatatttatgcttaccatttggggaaataaagagaaatgagaccataattatttctacaaaaattctgaaaatatcattattactaatttctattctttgacttattctgtgtccatttgggaaaaaagcattttaataatttttcttaaactagtttatatgcatagataaccagcagcatctggcttttccagatttaaagaccgctgctctgaccttgatctttcctcttctcttgtaaatcacagagatgtgggcagaggaaaatgtgattttggaatacccaaagacacacaaggtgt

SEQ ID NO: 640 - DNA, 661 bp, Homo sapiens
  misc_feature [331]..[331]: Chromosome 4, SNP identification no. = rs10518100
  misc_feature [331]..[331]: allele = a, in linkage disequilibrium with rs10518098, respectively
  misc_feature [331]..[331]: n is a, t, c or g
ttagatctgatttgcaacactcagcctattccattataaactggtgtctcagggagataacatcataaaggtaaatcttcccataagaaatgaaatataaatacaaaactactctaaaccaaaatttatttcaattgaagttagaatttattgtttcctttcaaaatatcagcataacatatccatcttaaatggagacttcctttgttgtgtttacatactaaataaatgttgttcttgtgccagataatcctgtagcatgaagggcttgcataactttctggagagtttgccatagcctattgttctctagaagcttctccaaatgaancatttctcagttcacacatctaaagcagtgaagtacataatgtaaattatgcacaagagcatgccattggcaacctctgttgcacatgtgcacccacacttacacacatacattcactcatacaataaatggatagcaaagaaaagtttcaaattaattgatgtccagtaaaaacagtcaatgtcaggaggaatatgatacccttgacttatctttcaactcttaagatttatatctagtaggaagtataagtgattctcattcacctactggccagatatttttgtggatcgacctagtgtactagataattacattcattttacctta

SEQ ID NO: 641 - DNA, 661 bp, Homo sapiens
  misc_feature [331]..[331]: Chromosome 4, SNP identification no. = rs9985540
  misc_feature [331]..[331]: allele = a, in linkage disequilibrium with rs10518098, respectively
  misc_feature [331]..[331]: n is a, t, c or g
agaaaaaaaaaacagaggaagatggacagacataaataaaaatacctcttggatgccacttacactcctggattcctggaagagaagcagtcaaataaatactacaaagtatgggatcattcctttaaaaacacactgacctgatcacctatagactagctctagcctcaacatgcttctgcctctgactaaacaatttaatatccccttttctttgggaagaataaggagtagatgaggagagagccaagtagagcaatagatgctcatgtagaactttgtccgttttctcagttatgtagttatccttcttaaaataaacacagaatcnacaagtgtgcagaatcaacaaattacccaactgcatgctcccccagaagtatcctagagacttggcaacatgacaatttgactcagttcataatccccacaacttgtaggcatcaattggagagtgtttgacagtgcattcttgcatgtgtgctcttaagcacacatgtacacatttgtataagtattttgttgcaatagaggagaatttaagtggtttgtttgtttccatgaatacatgtgaaggccttataaaatttaatatcttgtggtcattttatttacaaaagggccttgcctaatacgggacctaagggctcagaagttgtaa

SEQ ID NO: 642 - DNA, 661 bp, Homo sapiens
  misc_feature [331]..[331]: Chromosome 4, SNP identification no. = rs985302
  misc_feature [331]..[331]: allele = c, in linkage disequilibrium with rs10518098, respectively
  misc_feature [331]..[331]: n is a, t, c or g
atcattaaatttaacaattaagatactatatgtacaaatgaaaaaaccaaaaaaatatagagtaattaaaatcgttccacctatgaacgtttactgtaatacagtatttacagtatttcaataaagtttcggtctcactcgacaaaagtatataaaatacgttagtactatcgggactgagtctttatatcagatttggacaaataaaaagaaaacaggtttggtgagtgtcctgaataaacttactcgttcgcgagagaggtcccgacccggacctcacaagaggttccacaagatcgccgtatcaacaaggatcaataaatgttccaanggaggttgtagtggaggaaccactctatagggtagcaaacgaatatatttcaaagaattggtcagtgagagaatagatgacaaaccaaataaaagtgttttgcatactaaattagaacaaataatccacaagtaaaaagtatgagggtggtgattttagagtcttcactggagacggaacaagaggagtgggaacatacgaattacggatgttgtctaacctctctataaacaacttctctagtcactctacagtccggaggatactgtgatcgtccagtaaaatgttgaagactcgggaatccagggcataatccgttccgggaaaaca

SEQ ID NO: 643 - DNA, 661 bp, Homo sapiens
  misc_feature [331]..[331]: Chromosome 4, SNP identification no. = rs2117380
  misc_feature [331]..[331]: allele = c, in linkage disequilibrium with rs10518098, respectively
  misc_feature [331]..[331]: n is a, t, c or g
aatctgtcttttttctccttcctccttcgtttctcttgttagacatacctccctagtccgaacttccgttcgttctgtgccgaacaaattcgtttattttagatgtaaaaaatgatggaacaatttactgtgatctgtttcgtatacacagatttccttttatcacgataaatcaaacgtgtcttctttggtaagccctctttttacacaggttttaagacttatttgtacttgaaagtgtgggttaatttgttttatttagggtctttttttagtaaagttcaaacgatggagagggattagagtgtactaaataaacaagtgtttaacnaggtaagatcttcgttgattttactttgtaaaagaaggattatatgaactgggtaaatgatctgttattccctgataaacccagaaatagacgttttgtataacctctctcaacaaaactaacacacttaggaaaaatttcccctttgtgactggtcgtttattaagaaaatacgtcgagaattttgaagggggggtggaataggtgatctaccgtatatacatacatatatgtgtgtgtgtgtgtgtgtgtgtgtgtgtgtgtgtgtgtgtgtgttattgttgtataaattagtgtctctaatataagtatattatactttgtaatttc

SEQ ID NO: 644 - DNA, 661 bp, Homo sapiens
  misc_feature [331]..[331]: Chromosome 4, SNP identification no. = rs1865383
  misc_feature [331]..[331]: allele = t, in linkage disequilibrium with rs10518098, respectively
  misc_feature [331]..[331]: n is a, t, c or g
ttgtcttgaaccggactggacttcataactgattccgtcgaataacagaaactgcccgtaaaatcgaacaaataaatactatgttaattttctttcaaaacttctcttttctattaaactactgtataatcgtctttatttcatctaatagtctcttatgaggtaaagggtgaacggtcatcacagaggagaactgtggtgtaaatatgtgtatggaaagaggtatttcatgggatttaatattataagtgctccggtctcggtgtagatacaacaaacgataaaaaattagaaatcttacaacgagtgattgatcatgtattgttcgagngtaatttatgaatgattttaactttgtttattaactccaatccagtttataaatcttgtagaattgtgttatatcgtaataatgaattgaacctaaatatagaaatcgtagtgtagaatagtatctgatttttgacgattttaatggtatttaaattatcaattgttttgaaacaaatgtgacgatttgtaatttcattataacttttaccttctttttctcaacacaaaacagtaaccaatcctggttgagaaccggtgaaaccacaacagattacttacatagtcgacagtttagtcacattagtggattcggatctacctcgtgtac

SEQ ID NO: 645 - DNA, 661 bp, Homo sapiens
  misc_feature [331]..[331]: Chromosome 4, SNP identification no. = rs984406
  misc_feature [331]..[331]: allele = a, in linkage disequilibrium with rs10518098, respectively
  misc_feature [331]..[331]: n is a, t, c or g
aaaaagaaaactctatcccagaaaaagatagtgagtccggcctcacgtcaccgtgtcagtatcgagtgacgttggaacgggagggcccgagtccactaggagggtggagtcggagggttcatcgaccctgatatccgtggacgggggtacggtcagattaaaaacataaaaaacatctctaccccagaacggtacatcgagttcccctggagtttaaggacccgaggtcactaggaggacggaactgaagggtttgacaaccctagtatccgtactcgaagaaacgggtaggaagtaaaattataggaaataatttcgaacttttacaagngaaatttccaaaacaagtaagaaacaattaaattaaggttggactacactggtactccatgaaaaaatatgtgggttataatgattaattcattatagtttacaattgtgttttcacctctttattgaccttgtacgacgaccacccttacatttagacgtaccactgaggtctttcgttagacctccgagaatcattgaagttatacgtacctgggaaacggtcttgtaaagtgaggacccgtttgattacgtgttcagttactcctctgtactgtacgtgttcctataactagggtcacatcaaacactgtcactcctcgtgttacgt

SEQ ID NO: 646 - DNA, 661 bp, Homo sapiens
  misc_feature [331]..[331]: Chromosome 4, SNP identification no. = rs2175830
  misc_feature [331]..[331]: allele = c, in linkage disequilibrium with rs10518098, respectively
  misc_feature [331]..[331]: n is a, t, c or g
aggctctataaagtcttgcagctaagaaatttctttaattttgttttacccagcactttctttttcaattaatttgtccatttacagcttttcccattaaaatctgcagagcagagaaaatattctggaaagtacttatctaattttttttgcagtgtgtgtgtgtagaaattttagcttaaagtgtagcttaaaatcatgcttgaattggttaaaatgatgctatgtggaaaaaagatattaaaatcttacaaatgtttaacatttagcttaatttttacctcttgtttcacacaaggatttttttaaccatttcaacaagcattatttnatactacaattattgtagacactataggataatccaaattctgacagcagggaggaatagtagcacaaaggaaatgcagtggtagttctagatccaacattcattatagtttctctcttttaatataactttgagtacatagtctttcaagtccattttaatttctaatctgtgcctgtgcccataatcatttttacagtgctctagaatgaatacattttgaggaaagataatatcaagaagatgggtaagttatatgttaatctttaggaatttggtggtaaactttcataatcttaccaagaagtacacattgagtctctttttaaa

SEQ ID NO: 647 - DNA, 661 bp, Homo sapiens
  misc_feature [331]..[331]: Chromosome 4, SNP identification no. = rs1554017
  misc_feature [331]..[331]: allele = g, in linkage disequilibrium with rs10518098, respectively
  misc_feature [331]..[331]: n is a, t, c or g
agatccaacattcattatagtttctctcttttaatataactttgagtacatagtctttcaagtccattttaatttctaatctgtgcctgtgcccataatcatttttacagtgctctagaatgaatacattttgaggaaagataatatcaagaagatgggtaagttatatgttaatctttaggaatttggtggtaaactttcataatcttaccaagaagtacacattgagtctctttttaaaatgtcttctaagtcctcacgtgttagatggtgtaataaaggtaaagagaagggttgtaactgaccacaagaaattttacatctaatattngataggaccacttaaagaaaatttcagaaaacttaaagccaggcaccattctcattcttgagtttaagatgtaaaagaccaagtttctgtaagtctggggatcataatgcaacagaaaggataatgatgttcaaaaatcaatagaaggatgccaatacatatatatttaaaatgggaagaatatgcatgcatgaactttgcacatacatgcactgtgggctttagccaatatgtaagttttgttattttacaatatattttctcttttccagggttccttcaaagcttgcaattagttgtttttccttttaacaatgcacagctaaatta

SEQ ID NO: 648 - DNA, 661 bp, Homo sapiens
  misc_feature [331]..[331]: Chromosome 4, SNP identification no. = rs10006866
  misc_feature [331]..[331]: allele = c, in linkage disequilibrium with rs10518098, respectively
  misc_feature [331]..[331]: n is a, t, c or g
tcttaaatgtctatgccacatagtgaatgaaattgtcataatttaagtaatcctctattgatacataaatgaatttttttattctttgctattaaatatattgctacagcaaacatcctaacatatttatttttataccttttaattttgtttctataggaggcattgtaagaagtgaaagtctttgataaaagagtgcttatttgtaatgtcagtatatttttgaatcctctcagatccactagcagtgagttttcatgcctgatatggtttgactctgtgtccccacccaaatctcatcttgaattgtacccccataaataattcccangtgttgtgggagggaacctgtgggagataactgaatcatgggggtggtttcagtacccccatactgttcttgtggtagggaatgagtccgagatctgatggttttataaggggtttctgctttcacttctccctcattctatcttgccactgccatataagaactgcttttcaccttctgccatgattgtgaggcttacccagccacatggaattgtgagtccattaaatctatttttcttcccagttgtgacggttaatactgagtgtcaacttgattagattgaaggttacaaaatatggatcctgggtgtgtctgtgagggtgttgc

SEQ ID NO: 649 - DNA, 661 bp, Homo sapiens
  misc_feature [331]..[331]: Chromosome 4, SNP identification no. = rs1513894
  misc_feature [331]..[331]: allele = a, in linkage disequilibrium with rs10518098, respectively
  misc_feature [331]..[331]: n is a, t, c or g
agagagagagtgtgtgtgtgtgtgtgtgtgtgtgtgtgtatacagattctcttccttaacttgttctctttggtgtaaatgatgagccatcagaaattgtaaggcaacctgtaactcactttcaaaagaattgctgatagctctgtgttctacctacaaatttagaacaatctaatattttactggaaatgacttgtattattttgtattattcatctgtggcctttcaaaaggcaactttttgccagaggacaggtgtagcttaagatgaagtatatctgaacttaaatgagaatcaaacttctaaagctctggggagggagaatataantcatatgtatttacactaatttatctcaagaataatttttctatatacattctaattttaaaataacaataatttaataatatctaccaagttgatggtttcctctatgaagttttcaaaaggatggttatctccctgaggacatcaaaaagtcagcaagtcttcatatgggttttctaggcataaatacagcacagtccactgaatacatgtctcctaaaaattctttaaaggctctatgggtgacaccaagtccttgatgtttgctaaaatttggtttgttttattctttaagaactataagcacagtgcccagggactacgtgcttt

SEQ ID NO: 650 - DNA, 661 bp, Homo sapiens
  misc_feature [331]..[331]: Chromosome 4, SNP identification no. = rs11729217
  misc_feature [331]..[331]: allele = c, in linkage disequilibrium with rs10518098, respectively
  misc_feature [331]..[331]: n is a, t, c or g
tgtcaaccacatactagcctacctggtgaactaagatgtgattcaacattctctcatctctaaatttaaactataataatgtctccttccataacataaaaatttccatgaattcagtgttgtgtaacactcaagaaatctgtatttggatattcccaggagcgctgtagaagttaagggccgcctatacaaaagactaattacttcaaggaacagaaaaaataatatcaaagaaactcaataaatacagcatgctaaagtattttatgtgcctcaaattaatagcagcaatgggtatacagtgcttgctgtgtggcaggcactgctcaangtgttttgtccataacaatcctattagcatattagtaataatatatattagcagtatctacattgtacaaatgaataaacagtggcaagactgatgatgcgaattggccagtgtacaaaactcgtaagctgcaaagcaggaatcaaaacaggtgatttggccctaaagtccatttatttacctctccgctatattgttatttgtaaagatgaacactgcatgttgaatttccattgaccacctcttgtttgatagacattctcagtcatcttccacccttgcaattcaattgaattgttttatttttgcaaaaaatgcacatattaaaag

SEQ ID NO: 651 - DNA, 661 bp, Homo sapiens
  misc_feature [331]..[331]: Chromosome 4, SNP identification no. = rs6857543
  misc_feature [331]..[331]: allele = c, in linkage disequilibrium with rs10518098, respectively
  misc_feature [331]..[331]: n is a, t, c or g
taatatatattagcagtatctacattgtacaaatgaataaacagtggcaagactgatgatgcgaattggccagtgtacaaaactcgtaagctgcaaagcaggaatcaaaacaggtgatttggccctaaagtccatttatttacctctccgctatattgttatttgtaaagatgaacactgcatgttgaatttccattgaccacctcttgtttgatagacattctcagtcatcttccacccttgcaattcaattgaattgttttatttttgcaaaaaatgcacatattaaaagactttcctttttattttttaactgtgttttgtccttcangcatacattccccttttttgttttgtttcgattttgtttttttaatctcagctttgccagtgtttgccatcctggataatgcttttgtctgtctcactgcataaatctcaccatctattctttttcattatacaccactgtggagaggtagtttcagtcctgaggctctaatttgtttgtgtttgtttctcaaaacttcactgcaaaatttgaatataattataactactcatgtagaagtaaatttacataaaatgagcttttgtaagtaaaacttggagttagaaaagcattgcaaaacctgtcacatttttatcatttttgtttctt

SEQ ID NO: 652 - DNA, 661 bp, Homo sapiens
  misc_feature [331]..[331]: Chromosome 4, SNP identification no. = rs1398980
  misc_feature [331]..[331]: allele = t, in linkage disequilibrium with rs10518098, respectively
  misc_feature [331]..[331]: n is a, t, c or g
atcacactaccgcactctagcctaggtgaccaataaaataaaaatattttttaaaagtaccagaagtgctatatattctgacaactgttaagctgaaacataagtacatagtgaataatatttttttgacataaggaatgacacatgtatgtgtattctgagtaggctcacttgtcatataagacatcaatgctaaagaaagaaaaatatcttttagctaaattagctcttggtgattttttattacattttcttctttaagagttcactcaccacccaaattcttttcttaaatataacaatactactggtacctcgatctactacctancaaatgtcataagatcaggcataagaacaagtctccatatagatacatattctgtacacactcgtcaaaaattgttggagaacaaaatgaattttgcagatgaatgtttctttaacaataaccttgtcatttattttataatcattttttcaaaattcttctttcataatgtaagtgcttctcccctctttaaatagaaaaagagggctataatttaaatcatattccggcttttgtcaagagcattcatcatttatgtggcattttcgtattttatctgttcatcattgcattaatgttaaactgtcagccactatttctgttattgtg

SEQ ID NO: 653 - DNA, 661 bp, Homo sapiens
  misc_feature [331]..[331]: Chromosome 4, SNP identification no. = rs7681169
  misc_feature [331]..[331]: allele = a, in linkage disequilibrium with rs10518098, respectively
  misc_feature [331]..[331]: n is a, t, c or g
attcttctttcataatgtaagtgcttctcccctctttaaatagaaaaagagggctataatttaaatcatattccggcttttgtcaagagcattcatcatttatgtggcattttcgtattttatctgttcatcattgcattaatgttaaactgtcagccactatttctgttattgtgtccacttcaatcatttttccatctatcagtctatttattcattcattattcaacattcctagcaactagcactggagtgtaaaaaagcctattacttaaaaagttgtacagtttaattggggatccagacaagtgataaaaatggcatttcggcnttaaaaatctgcacagggaacaaaggaaataccaagaggagtcactgtggagtcagaagaaggttgagagaatcttgaattacaaacaggagttagaaagggaagtggaaagtggtgtttggtgaaggaatagacttagaacaaggaacagtatgtgcaaaggccagagttatgagctactaaagaaactaaaaaaggaagggtgatcatatctctgttttaaaaaaaatcactctaacattgcttttcatctcttctggattttaaatttataacatgctgtgcttggcgaacagctaaataaatgttaaagaaataaaagataaataa

SEQ ID NO: 654 - DNA, 661 bp, Homo sapiens
  misc_feature [331]..[331]: Chromosome 4, SNP identification no. = rs10433664
  misc_feature [331]..[331]: allele = a, in linkage disequilibrium with rs10518098, respectively
  misc_feature [331]..[331]: n is a, t, c or g
ctcttttatactcaattaacattttggaggttagagagttccaaaaacaaaattgtgaagccagaagttaaggcaaacagtcacattttcaatatttatgaattatttaagaatcatacaactctaattgcaaagtcaacattatattgccacatatgcaattatatgtatttacatgttttgttggtatgtatatattttttcacatttagaaataaatgtgattctgcatatattattatggattctaaaataaaatataataattattatcaatggggaactctggctatttatttaaaagagattcttcaacaaacaaaaagcgganaagaagatagtggcactcaactgagaatggtggtatcatgaaatgtgcaataatggcttgctttcatttattttaaacacgtatatgtacatgtgcaatggtttcaacataatccaaggggccaagaacatagctgataaagaggagaaaatgagactatcacagaaggctgcattagagaatgcatggatcagaaatcagtggttaaagtgttcacttggtctagatgccaggagcaaggagaaggtcattaaaggatttaaatggcagtatggaggttttagcttccacatggcatttattgatataatgcttaatgtacatgattta

SEQ ID NO: 655 - DNA, 661 bp, Homo sapiens
  misc_feature [331]..[331]: Chromosome 4, SNP identification no. = rs10050160
  misc_feature [331]..[331]: allele = g, in linkage disequilibrium with rs10518098, respectively
  misc_feature [331]..[331]: n is a, t, c or g
aacttttgtaacagacacagctgggctaatagtctaagattctgaatattctgttccaatagtatttgcctatgttgccataattaatttctacaatttgtctagcatcagacattagatttccacccctatagcttttttgtttctcaagttaaacaccacgtaaatcccgtaatttacaagccacagattagtgttgtctttttcttatatagctttatcaatttttcttctacatattgacatgtgaatgtttttctgagtctctgagctacatgtaaagtaggaacaaagacaaaaaggaagacagcatttggccaaaggcagtcantataagtactagtggctcagctcttttttcttcactactgtcttctaaattcaactctatttttatgtctctactgtttatacatatttatcaatgaggttgttcttaatgagtaattttgaattcttccactattcatcaaatatgtggatcagaaaaatcccagtgtgcagagcatcagaattacattatttaacatgggcttgtgtttgcacgctgggaaggctgcagtgctcccttcctgtcatggtttctccttttgaccatcttagttgctgtaagactggccatatagcctttgccttaaagttgtcaggagctcactagtat

SEQ ID NO: 656 - DNA, 661 bp, Homo sapiens
  misc_feature [331]..[331]: Chromosome 4, SNP identification no. = rs6446823
  misc_feature [331]..[331]: allele = g, in linkage disequilibrium with rs10518098, respectively
  misc_feature [331]..[331]: n is a, t, c or g
tgtcatggtttctccttttgaccatcttagttgctgtaagactggccatatagcctttgccttaaagttgtcaggagctcactagtatccagtgcccccaatccctatacaatagatataaaagtctactatatgccttctagccattagaaacatctttactaattttttttatcaaaatgggaaaaacaacattagttcccaattttcacaaatatgcttaacccatttttttcatgtgccaagccttagcataatatttccatgttaactttatgtcatttaacataaggacagacttcttatacagtgtgacttttatatattgttnttctcttaaaaaagggtattttcttcttttctgctttatgtcacatcaaaattagaatagatgttactcaacttattaacaacacctctctattctttatgattttatatttggcataattaagtaaacataaagtagatttgaaatagataaaagtacaagaaaaaaatcagccaagaaatgaaaataacaaaaaataaaatgcctaaatttattgtttacccaatcactgatataatgctaaaactttttaaatgtattatgtggtttatcttcatgcaatgctgtgaagtaggcacaattattgccttcattttgtagatgagaaga

SEQ ID NO: 657 - DNA, 661 bp, Homo sapiens
  misc_feature [331]..[331]: Chromosome 4, SNP identification no. = rs7679388
  misc_feature [331]..[331]: allele = g, in linkage disequilibrium with rs10518098, respectively
  misc_feature [331]..[331]: n is a, t, c or g
atgatacataatacaaggacagctaaatattcattagatttgacaatatggcagcatgatggttaattttatgtgttgatgtggctaggccaagaggtgtctagatatttagtcaaacattattctaggtgtttctgtgagtatttttggatgagaataatttaaattggtggacttagaggtaagcagattgccttcataacgtgaatgggctcctttcattcagttgaaggcctggatagaacaaaaagaccagtttccctcaagcaggagcaaattctccagcagaccacctttggcctgcatctgcaacattggctcatccatcccngttctatggcaaactgctgttaaactgtaagtatagcattgggtctccagcctgtcagaccagcctgcagttggacttgccagcctccatcgttgtgcgagccaatttcttataataaatctgtttctctggagaaccctgactaatacaggaggtcactggggacttttttgacatgatcaatttcagaagacgattggggtggaaacaactatggtaaagaagagagatgagcaatgacaaaatgaagacaacacgtataggcaattctttcaaaaagtttgtctaaaaagaagagcagacaaagtgaggtagaagttgctgagaatg

SEQ ID NO: 658 - DNA, 661 bp, Homo sapiens
  misc_feature [331]..[331]: Chromosome 4, SNP identification no. = rs17031951
  misc_feature [331]..[331]: allele = g, in linkage disequilibrium with rs10517602, respectively
  misc_feature [331]..[331]: n is a, t, c or g
aaggaaaaaaagtcttcctcttctggtgaattcaatcttgttgtttgactcattgcattcttaggtaaaatgtctatttatacacatatttacatctaaacctcctagcttaatttttaatggccatgataaggctgacgacttgtggggtttactcagaagtatatacttcctttagcagtccttgtatttggtaaaatatgttctaattcatcttttcttctgtagataagaattgctggcaacatatgcactaaacttcgttttgaaaaatccccttgatgccgatcactgagaagtgatccacaggtgagcgtctaagcattgaacnttttctattctgtgcttttttctttcgtgtgttgttgatgtcaggctgttatcaacacattctatgaaacaggaccctaggtatatgcattataacacgaaactcattataacacagagtatagaattagggataaaataggagtgaaatcatttttgatagcttcttagtgaaacataattgtctttattttaatgagtgttgttttagaggatttgaagatcatagagcacaagagaaaacatagtgcctttacatttaacttcgcgtgtgtgtgtgtgtgtgctcataaatgacttaattttaaagctaaagattatttagtattct

SEQ ID NO: 659 - DNA, 661 bp, Homo sapiens
  misc_feature [331]..[331]: Chromosome 4, SNP identification no. = rs17031954
  misc_feature [331]..[331]: allele = c, in linkage disequilibrium with rs10517602, respectively
  misc_feature [331]..[331]: n is a, t, c or g
agaattagggataaaataggagtgaaatcatttttgatagcttcttagtgaaacataattgtctttattttaatgagtgttgttttagaggatttgaagatcatagagcacaagagaaaacatagtgcctttacatttaacttcgcgtgtgtgtgtgtgtgtgctcataaatgacttaattttaaagctaaagattatttagtattctatagattaagatgaatcattatttgaggcaaagaaagttattatcttattaatatatggtccagagtcagctaaagtcagatactatggaagtgggttgacatgtgcctgggtcatcctaagnaggaaataaaatcagtactttagctcagtccattgtatcacttagccttaacatttgcaaatgattttgaaaccttgctatatttagctcttcttaattataattgacaattggtggtggctatataatttttaataaatgcatagtaacaatgtcttatttagtaggagtatctcttaggttctcatgaatatgtgacggggactgccttaccttcaggactataccatcgatctcactgggccccattaccttgtggcaatgacctgaggtttgacaaaattgtaagaaccagcctcagtaacagtgtttctcaaagtgtgagtattg

SEQ ID NO: 660 - DNA, 661 bp, Homo sapiens
  misc_feature [331]..[331]: Chromosome 4, SNP identification no. = rs17031957
  misc_feature [331]..[331]: allele = t, in linkage disequilibrium with rs10517602, respectively
  misc_feature [331]..[331]: n is a, t, c or g
tgtacttattatcattgtatcaaatacaatctcatttacccagagcatttaaataggagtcactgttaagaatgtgtgacctgaaagataataattctaataatagaatgctcaaaacacccagtaatgttctattttgtgcatcaaagcaaaatattgggcaaatggtactggacttccagatcaaagatatttctaatttaaagtcattagtggatggacaaaagagcttcagctttagaaaacttattcttaggacaaatgcaaaattgaatcccagataaaagaatacacaagataggcagtataaataaacaccagcgtgatagantgaataccagcattaacaatgtggtcattggaatgtggaagggagtaggtaatttttaacaaatgtagaccaactatctcaccaaatatataacatacgagacaagaagactggtatatatatacatatatatgtatatgtatatatatcttcttgtctcatatatatatgatatatatatgtcttcttgtcccatatatgtatatacacatatatatatacacatatatatacatatatacatatatatacacacacacacatatatatatctcctataggcattcgatgaagatgttcttttttctgtaaagcatatacttaaaaact

SEQ ID NO: 661 - DNA, 661 bp, Homo sapiens
  misc_feature [331]..[331]: Chromosome 4, SNP identification no. = rs10517602
  misc_feature [331]..[331]: allele = a, t
  misc_feature [331]..[331]: n is a, t, c or g
agaaagaaagatcaagcttttgggaacatgtatgtaaaattttctacaattattaatgctctaaataggaatagaattaaaacttgtttttcatgaagatttgtaatataagcaaatgacctactactgtcactctgtcaatttattacacatcaataacttccataaatttcctggttacatcaagctttgagtcatctacatgggctggtagatgacctcaccaactggttgggtttaggattttacttcttcagaatctactttacaaactaaagtgggtaggaacaaaccctttttgacttcacttccaaatgtttctggagctacncttcttaatctccttcctcctttcctgtctcagaggaacagaagtccttcctcctcatcagttctaacttccatctgcagttttgatcccatggcttcccacctcctctggactgatttccatcatttatttatttatttatttagctgtgtttttcttctccattgagtctccttttatgtacaaatatcctcctgtgttctccatttaaaacaaatttaaaaattaaaagtaggccaggtgcagtggctcacacctgtaacacctcccagcactttgggaggccaaaggcaggaaaattgcttgagcttaggcatttgtgaccagctg

SEQ ID NO: 662 - DNA, 661 bp, Homo sapiens
  misc_feature [331]..[331]: Chromosome 4, SNP identification no. = rs12501328
  misc_feature [331]..[331]: allele = g, in linkage disequilibrium with rs10517602, respectively
  misc_feature [331]..[331]: n is a, t, c or g
ccacctttcttaacggtccgggaaaccagaggtctctccagctactcagggtagaggaatttctcctatctccatgtgacatcttctgatttagaagaactaatgttagatttctcttgggcctttccacctacagctatagtcttccctttgtttagctaaaattgaggcaggtaggaaaatattattgggggcataagcctattagtgtgtaaacgtatttttatgaagtgtgcctccagggagccattaaaaactgacctctcaaccacagaaatagatgagattttgagaacattgagaagctgccttttgcaaagtaaatttgcantggtccttgacgaaggggggtcgggggcggggagaagtccagccgagagaggagctcattccacgctatatttttgcagttgaaaagctgcctaatcatcgctaaccgcttcccgcataagagttctgggaagacttcagaaacaaggcaaatgaagacttttcactgcctccttcgggctgtcgcttccggaagccgaagtcctagcacgcagagcagcaggagagggttactttcaggcaattccactgagcaaaataaatcacttaatggcataacgttctggcttaaaaaattggaatttatcagaggcaaaaatatccttcaaga

SEQ ID NO: 663 - DNA, 661 bp, Homo sapiens
  misc_feature [331]..[331]: Chromosome 4, SNP identification no. = rs1876031
  misc_feature [331]..[331]: allele = g, in linkage disequilibrium with rs10517602, respectively
  misc_feature [331]..[331]: n is a, t, c or g
ccgaatattacgaatactgacggaggtggaccccttgaactccctctgttttcgtacctcttaacgaagtcccgaggtgtatcgatatatgtatatatacttaagaaaatacatatatttttatatatgtatacatatgtaaaatatatgtactttcttaatcgatatctgagttatcggaacagggtggcgcaaaaccttctgcgttcgtcacggttcgactaaacgcaaagtaaaaagaaaaagggggccaccccaggtgaaagaccggcggaagaaccctttcccgaaatgaagtttttctttcctccactctcgctatgctccgtanttagacatatccaccgagttctacgtctatgagacgacggtacctttacttatcccgcgcctcacaggtatcaaagaacttcctataaaaacggagactatttaaggttaaaaaattcggtcttgcaatacggtaattcactaaataaaacgagtcaccttaacggactttcattgggagaggacgacgagacgcacgatcctgaagccgaaggccttcgctgtcgggcttcctccgtcacttttcagaagtaaacggaacaaagacttcagaagggtcttgagaatacgcccttcgccaatcgctactaatccgtcgaaaagttgacgt

SEQ ID NO: 664 - DNA, 661 bp, Homo sapiens
  LRAT
  misc_feature [331]..[331]: Chromosome 4, SNP identification no. = rs3775785
  misc_feature [331]..[331]: allele = c, in linkage disequilibrium with rs10517602, respectively
  misc_feature [331]..[331]: n is a, t, c or g
gttcttgtgaagagactagtgcttattaatagaagtgtcagagtgttttgaccttttattttataaccttttaatcctttccaccgatttgggttcttcttagtgtatatagtttgtcatttagtcaaaagggtcgataaaagacagatggtcttcttgatctgaaaaagaatactgaatgtttttttaaatgttacaattctcaggtcaagactaagatatggcatatcatcgtctttactagggaatccgttgattattaccgtcaacggatacatttatgtcgtaaatatcttttgatatctttcatattggtgtaccaataagtccngatttccaaattttgtagtttgacgaatagttattgttatcgtataaaattttaatctactcgtttctccacagagattagaactcatttttattatcttaaaccggttaattttcatctaagttaaggaggttagacggtaagattttagattactatggttactattgaaaaaatattcagagttttagatgtccgtatctttcagattaaaataacagtttagggtaaaggactgatttatacgatttaagtcctagttaatacactgtgtattgaccgacgacctttttttctgtttataacaggaatggggactccttacgtagg

SEQ ID NO: 665 - DNA, 661 bp, Homo sapiens
  LRAT
  misc_feature [331]..[331]: Chromosome 4, SNP identification no. = rs12507608
  misc_feature [331]..[331]: allele = g, in linkage disequilibrium with rs10517602, respectively
  misc_feature [331]..[331]: n is a, t, c or g
tactctgaaatttttaaaagccttcagatttgttttctagtcacttttttccatatcatttctaattatagtttatatccttaaaagaaggatgccacagtagtatgtaaaacccaaacaagtagaacccaagcaaataaaattatttaaaataattttaaagtggcttagtactgccagtcatgtaaattgattctgctgagggtcttataagaattgagatataacaatggtaaaacaagcattcaagcacttttacaaaattaccaaattcttaaaatgaagccacagctagacttgcatttcaggtattaaaattgctttcttaacngtcaagaatcacaaaataacaaatcatattatgagtgaatatggggagggcggggccaatcagtcaatgataatctgaacaaattttaagagcagattttagattaataatgttttatcaccactaatttgcccacaacaaactcagtatttaatttttcaaattaaatattaaattatttaagtattttaaataattaaaacattaaatggcaacaccatagaatataggtgttctctggacctattctaaccacttaaaattatcttaagtatgcatacataaaagcaaccactatgagaactaccgtgttagtggtttttcacttac

SEQ ID NO: 666 - DNA, 661 bp, Homo sapiens
  LRAT
  misc_feature [331]..[331]: Chromosome 4, SNP identification no. = rs17032000
  misc_feature [331]..[331]: allele = t, in linkage disequilibrium with rs10517602, respectively
  misc_feature [331]..[331]: n is a, t, c or g
cctgtaaccccagcactttgggaggccaaggagggaggatcacaaggtcaggagatcgagaccatcctggctaacacggtgaaaccccatctctactaaaaatacaaaattagctgggcgtggtggccggcgcctgtagtcccagctactcatgaggttgaggcaggagaatggcgtgaaccgaggaggcggagcttgcagtgagtggaaattgcgccactgcactccagcctgggcaacaaagtgagactccatctcaaaaaaaaaaaaaaaaaaaaaaaaaaaaaaagaagaagaaaccctgagccattaatgtgtctcgtaacttgangaagttcatgaattctctgggcttcatccattaagattcatccttatgctcctgcaagtttcttatatttatgtatttctattctgatttctgaaatgataacctagtagtgtctgatgaagttttttcatgcttattttattctttgtcacagatgaaagaagaataggactaattggggctaagatgaattaatgtaagtgtcagatactaggcaggtgttagggatgaaatgatgaatgaggcatggacctgttcctcagagtttatggcccagtagacataattgtattaggactttctgcagttgacatttgcataaagctgact

SEQ ID NO: 667 - DNA, 661 bp, Homo sapiens
  misc_feature [331]..[331]: Chromosome 4, SNP identification no. = rs1392546
  misc_feature [331]..[331]: allele = g, in linkage disequilibrium with rs10517602, respectively
  misc_feature [331]..[331]: n is a, t, c or g
ttttgtttgtttttgtttttgagacagggtctctctttgtcttacaggctgcagtgtagggacacaatcctagctcactgtaatctcaaactcctggtctcaagcgttcctcctgcctcagcctcctaagtagctgggactacaggtgcatgccacaatgcccagctaattttcaatttttttgcagagatggagtcttgctatgttgcctgggctggtcttgaactcctggctttaattgaccctcccacctaagcctccaaaagcactaggattatgggtgtgagccaccaggcccagcgacaacatgggttttaactgggtgggtccntttacgtgcaaaatttttcaaccaaatgtggacagaaaaccaagtattcctaggatctgaaacctgcttatatagggagggccaacttctgtatatgtgggttccagttcctgcagggctgactgccagacttgactatgtgtggatttgggtgtacatgggggtcctgggccaaacctctgaagatatcgagggaacactgtaaccagatttatgggtgaggaggtgatgggatgtgagtagaagcaaattccagggccagtcttgaaatacattcatagcagtgccaaggaccatagaggttactgagcttgatgcttagccatccaa

SEQ ID NO: 668 - DNA, 661 bp, Homo sapiens
  misc_feature [331]..[331]: Chromosome 4, SNP identification no. = rs1500372
  misc_feature [331]..[331]: allele = a, in linkage disequilibrium with rs10517602, respectively
  misc_feature [331]..[331]: n is a, t, c or g
ccaaactttgcaactgggtcccgtgagtattaggaccatgtgattttctgaaacacatgaagaagaggtgtgcagttagtttgtgaggaaaagaaacacttttttttttttggatggggtttcatttaaggttacaaggagaagtggaaagtacagaaatcacttcagtgctcagcagatgaatagtcactgctccctgctcagctcacaactgttcctgcatcctcaaatgactctagtgatatcttcttctcgagtctggattctggtgctgctatttgctcccatttagcttatgatggctactcgcgtggcggcccacctactgccnctaactcacactgcaccattgtttctgctgccttgtggttttcattacacttctaccctgttacttttagcttctgctccactgtacctggtcgccgtctttcatttaaaattgcaaagggatctaaccaagctgaccagtcactatgcaatatttgtggtcacagtaaacagttctctagccaggctactgaatggaccattgattcccctgatggcctttaggtctggtaccttcagatcaggtgacatccttaggctaatcacttgttgccaaattgcacgaccatgtgttcccaggcatggagatctactcttattcttaaggagc

SEQ ID NO: 669 - DNA, 661 bp, Homo sapiens
  misc_feature [331]..[331]: Chromosome 5, SNP identification no. = rs269511
  misc_feature [331]..[331]: allele = a, in linkage disequilibrium with rs2963765, respectively
  misc_feature [331]..[331]: n is a, t, c or g
taatagtcgtaatagtaaatatatttaatcaagaaggaatcaaagttcgctgtatcttggtttgagtttaactgaatcctgtctttcgtttaagtagccgagtccttcgacattccgggtccctgatccgaccgaagtctgtaccgatacagtaatcctgagttaaagagagagggagaagttaaacgacgggtgacaaaactgaagtaaaagtcagaggtaaatcaaagagaccttcgaggtccgagagagaagtgtcactgttctaacgaccctgtcgaaagtgggacatacaagagtccgatgacaaacccacttttctctcttaganaaggtcatcgaacatttgttcaggactctaaatacgactaatctggtctaatccatcacacggtagagacttagttactaacatctgtctccttatacgttgtataagatacccaatccggactcagtacacaggaatcttggtccacttactttggggacccgttcccgacttagacgttagtcttagtcctagacaacaatttctttacttttcgtccgactcgtaccaccgagtacggacattagggtcttgaaaccctccggttccggtcgtctaccggactccagtgcttaagctctggtcagaccgtttgtaccactttggggt

SEQ ID NO: 670 - DNA, 661 bp, Homo sapiens
  misc_feature [331]..[331]: Chromosome 5, SNP identification no. = rs12654556
  misc_feature [331]..[331]: allele = t, in linkage disequilibrium with rs2963765, respectively
  misc_feature [331]..[331]: n is a, t, c or g
tttccttgacccttttgtgggccttgagacacgggtgccttgcttactcagcccacagctctcaacccctcatgggaggggaagcacacaggtgagcaggtgcaagagccagagtgagtgcttttgcgcactgggaggagcaaaattccatgctggtctcatggcagggtctagtgggtagtacctgcgaccctgaaagccccagaaggagtgttacaggcagcactcttttagctttgccatccatggataggttaagtgtttaactgctcagtgaaccctctgtcttttcgtgagggtagagggtcagtgtgacagccttttgtatccngagctcttggacagcatccaggaaaaaccaggtcacacaaatgaattgaaagatagtaaatgtggaggatcttattgctaatggaagtggctctcattgggtaggggagctgaaaaggggatggagtggaaatgtcttcttcccctaaagtccagccttctccagcctgcggtttttatggatgcaggacgggggtcagggtgggccatgggtaattttgcaaaaggcaacattcgagcaggaaaacagaaatgcatgttctcactttgggctgcagttccaggcttaagggtggggcttcaccagggacctcgcccttctgcctagaat

SEQ ID NO: 671 - DNA, 661 bp, Homo sapiens
  misc_feature [331]..[331]: Chromosome 5, SNP identification no. = rs10519405
  misc_feature [331]..[331]: allele = g, in linkage disequilibrium with rs2963765, respectively
  misc_feature [331]..[331]: n is a, t, c or g
actgtgttcaatcaagttatgtttagacatagtcccagtttttaaccactaaaatgaattcagaagtgctgttcctcttcctatatggcactcttacatatcatataactcggggaacagcctggagtgcagcagtttatttactgtcttttttatttccttattttcaaatactcaggtccaaggcttggctggctaggacagtgcttatcaatttcttcacttggtagattttcccaagtaatgaaaaaagccaataacagggagagaactttcctcttggtattttaaacttttagggggtccccaaattgcactggattatctgccnctaattagagattaggaattggtgtgaagggagagagggagtgtctccacagagaggttacaccttcctttaaaagccataccactgtagattttgtgtatcacttcatggatgcctaaggatgggcacttttccttttaaaatcaacattgttgaatgttttctatattattctgttggtacctaccctctagagcacagtgtggcagactctattttccaaagatggccacaaaactttctctggcagtggcagcataaccttgctactcccgctttaagaactgaagtctatttctccaactccagcccttctccccttgaacccaa

SEQ ID NO: 672 - DNA, 661 bp, Homo sapiens
  misc_feature [331]..[331]: Chromosome 5, SNP identification no. = rs10519406
  misc_feature [331]..[331]: allele = c, in linkage disequilibrium with rs2963765, respectively
  misc_feature [331]..[331]: n is a, t, c or g
ggcactcttacatatcatataactcggggaacagcctggagtgcagcagtttatttactgtcttttttatttccttattttcaaatactcaggtccaaggcttggctggctaggacagtgcttatcaatttcttcacttggtagattttcccaagtaatgaaaaaagccaataacagggagagaactttcctcttggtattttaaacttttagggggtccccaaattgcactggattatctgccactaattagagattaggaattggtgtgaagggagagagggagtgtctccacagagaggttacaccttcctttaaaagccataccacngtagattttgtgtatcacttcatggatgcctaaggatgggcacttttccttttaaaatcaacattgttgaatgttttctatattattctgttggtacctaccctctagagcacagtgtggcagactctattttccaaagatggccacaaaactttctctggcagtggcagcataaccttgctactcccgctttaagaactgaagtctatttctccaactccagcccttctccccttgaacccaagtagaccctttgactgctttgaccaaaagaatgtggaagttacattgtgttaattccaggtgtggctcttaagtgttaatttcctg

SEQ ID NO: 673 - DNA, 661 bp, Homo sapiens
  misc_feature [331]..[331]: Chromosome 5, SNP identification no. = rs2963765
  misc_feature [331]..[331]: allele = g, a
  misc_feature [331]..[331]: n is a, t, c or g
tctacctcaaagcgagaacaacgggcccgacctcacgtcatcgtgttagagtcgagtgacgttcgagacggagggtccaagttcgataaaaggacggagtcggagggttcatcgactctaatgtccgcggacggtggtgcgggccgattaaaaaacctacaaatcatctctgctcaaaacggtacaacccgtccgaccagaacttgaggaccggagtccaatagacggacggagccgtagggtttcacgaccctaatgtccgtactcgctgacgatgtcaggacaaaaacatttataatcgaggataccctaacgatttctcaccttattnccatcatgttgtaccttcagtacaacctgagacggtcggataatcacaagaggaggtactcattgtcatcgaccagggtctcacatgggggtgtcgacttgtaccgttcactccttatatcatcacggacactacaggtaagtggggaacaaaaataaaaaccgagtcaagatgggtgacaagacagacctttcacaagtaatgtaccaaaaagggttagaaacccgtaaaacgggaacggtggtatcgagtcgtcggagatgtgacactaaaaaaaaattaatccttaaagtgaaaaaaaaatgacacgattataagaataatcataac

SEQ ID NO: 674 - DNA, 661 bp, Homo sapiens
  misc_feature [331]..[331]: Chromosome 5, SNP identification no. = rs2964560
  misc_feature [331]..[331]: allele = c, in linkage disequilibrium with rs2963765, respectively
  misc_feature [331]..[331]: n is a, t, c or g
caggatatatatataaaaaaacaaacaaacaaaacaaaacaaaaaactctacctcaaagcgagaacaacgggcccgacctcacgtcatcgtgttagagtcgagtgacgttcgagacggagggtccaagttcgataaaaggacggagtcggagggttcatcgactctaatgtccgcggacggtggtgcgggccgattaaaaaacctacaaatcatctctgctcaaaacggtacaacccgtccgaccagaacttgaggaccggagtccaatagacggacggagccgtagggtttcacgaccctaatgtccgtactcgctgacgatgtcagganaaaaacatttataatcgaggataccctaacgatttctcaccttattaccatcatgttgtaccttcagtacaacctgagacggtcggataatcacaagaggaggtactcattgtcatcgaccagggtctcacatgggggtgtcgacttgtaccgttcactccttatatcatcacggacactacaggtaagtggggaacaaaaataaaaaccgagtcaagatgggtgacaagacagacctttcacaagtaatgtaccaaaaagggttagaaacccgtaaaacgggaacggtggtatcgagtcgtcggagatgtgacactaaaaaaaaattaa

SEQ ID NO: 675 - DNA, 661 bp, Homo sapiens
  misc_feature [331]..[331]: Chromosome 5, SNP identification no. = rs269503
  misc_feature [331]..[331]: allele = c, in linkage disequilibrium with rs2963765, respectively
  misc_feature [331]..[331]: n is a, t, c or g
tttattgggggagggtcttgcctcagtgaggctgctaactgatcagggtggtggctgctgaaggttgaggtggctgtggcaatttcttaaaataagacaacgtgaagtttgccacatcacttgactgtttctttcctgaaagatttctctgtagcacgcaatcctgtttgataacattttacccacagtagaacttctttcaaatatggagtcaatcttgtacatctgcatcagagctctcgggtgaccaggtgcattgtcaatcagcaacaatattttgaaaggaatctttttcttctgagcagtaggtctccacaggaatagggctatnacacttcctcatcctacatgttttcacaggagtagcacttttaatttccttcaagaacttttcctttgcattcacaacttggctaactgtttggcacaagagggttaactttcagcctgtctcattttaaacatgcctgcctcactaaatgtaatcatttctagcttttcattcaagaaattcattaagaatttcattaattccctggaacacttagcagccattatggctttatttcttagcctaatttaaacactattgtatctcacaggatagggaggcccaaggagagggaaagagatgggggaacagccagttggtagagcagtt

SEQ ID NO: 676 - DNA, 661 bp, Homo sapiens
  misc_feature [331]..[331]: Chromosome 5, SNP identification no. = rs10463669
  misc_feature [331]..[331]: allele = c, in linkage disequilibrium with rs2963765, respectively
  misc_feature [331]..[331]: n is a, t, c or g
gtgttccacccttcgtgggagggagtgcaaggtgagcaggtgcaggaactggccagatgctttagcactggcaggagcaaactctgtgcaggccccatggagggcagagtgccagtgcaaccgccttttgtatgcacaattgtggcttccgagctcttgtccagcatccaggaaaaatgaggttgcatgaatgaactgaaagatgataaatgcaggggactttattgccaatgaaagtagctctcagtgggaaggggagctgaaaaggggacagagtgggtaggtaatcttcctctgaagcccagctgtctccggcaggatgcttctccgnagttatatgccatcaagctgtccttctgaagtcaagctgcttctctccaatgtccagctgtagtcctgtctaccagctgaatctggggtttttataggcacaggatagggtggagtgggagccatgggtggttttaggaaaagacaacatttgagcaggaaaacaggggtataagttctcactttggactgtggtttcaggcttttcagcataaggatggggtttccctggggacccatctttttctgcctagaatttctctgccctgtccctatcacttctattatgtgctttgcatgtggcaaacatacttctgtgctgagaatctca

SEQ ID NO: 677 - DNA, 661 bp, Homo sapiens
  misc_feature [331]..[331]: Chromosome 5, SNP identification no. = rs12657417
  misc_feature [331]..[331]: allele = a, in linkage disequilibrium with rs2963765, respectively
  misc_feature [331]..[331]: n is a, t, c or g
cctatgttcagggaagtattacatgtttcccaggatatatttggaagctcaatactttcctcttcaatgcatagtggttcctgcccatttccttcttttacttaacaataaagggactaatatgtctgttattattttttaatgtcaggaaatcccagttatttctcacagtggcaactctttttctttgggaaaaaaaccaaggttctctaacagttgctctgactataactaaactgtaaagataacttttagagctcatcgaagaattaaagaggcacctcatttgcttataatgccttttatgtgtgggtcactgtacctatttctngaggacagaatttggtctataggaacatggtcaggcccagacctaattctgagtaggaaaaacatatcttggccatgaccttgagccccctgcctttcctcccttctcttgttccctcaccattaaatgcttgttagctgcctatattgctgctcttgactttctgctctcatcaccaaggcagacaactggttttcttttctttccattttcactgcagacattgaagttctgcagtttccagcaagcaaatcgggcacaaaaatagtctcctccagttgagtaggtgatggttacctggatgggagtaatacataggaggcttgtcac

SEQ ID NO: 678 - DNA, 661 bp, Homo sapiens
  misc_feature [331]..[331]: Chromosome 5, SNP identification no. = rs2925172
  misc_feature [331]..[331]: allele = g, in linkage disequilibrium with rs2963765, respectively
  misc_feature [331]..[331]: n is a, t, c or g
acctttgtcgaactgtaaggaactatccgagtgtattgtcaagtatccgtgtttctgtcaatgtgaaacggtatcgttgtttgagtaaatgggatcactccatccggaaccgttccgataatcgacgggagtatcgaatcgtctgtgaaccggtgatccgatgtccgagacaccctccacggggtacgttgaggtttaagtccgggttactcgttaagttacagtagtctaaagttcgactagttacccgggttccggaccatgatagtatttcttcagtacctcgtgtaccaccctaccacccagagggggttagggagttcccattacnagtcgagacacataaagacccctccgaggtggtcggatgtgaatggtcgtgaggaacctcctcaaaacacaggaaagtacctcgtctatcctctttttattagttttctctcctcgggttttactcctcttttcctttcctattccctaaggcctcggaatgtatccttggtcagaaaaacgaagagtccgggaggacgtatgtggtggaacgtcttgtccgagtcccgaccacataatcattcccaagaggtctcactgtcggggttattttacctacctacctacctatctccctacctatctattacctacctacctctctctctct

SEQ ID NO: 679 - DNA, 661 bp, Homo sapiens
  misc_feature [331]..[331]: Chromosome 5, SNP identification no. = rs17383755
  misc_feature [331]..[331]: allele = t, in linkage disequilibrium with rs2963765, respectively
  misc_feature [331]..[331]: n is a, t, c or g
ttgggggagacccaccatcccaccatgtgctccatgacttctttatgatagtaccaggccttgggcccattgatcagcttgaaatctgatgacattgaattgctcattgggcctgaatttggagttgcatggggcacctcccacagagcctgtagcctagtggccaagtgtctgctaagctatgagggcagctaatagccttgccaaggcctacctcactagggtaaatgagtttgttgctatggcaaagtgtaactgtctttgtgcctatgaactgttatgtgagcctatcaaggaatgtcaagctgtttccagttggccaagttctatnctgtctgccctgatgcttcaaggagataaaagacctcggcattctctacagcttgctggatatgaatcatcacatgcatcctgctttcaagcagctgctgcataatcctctgcaggcacagggtggaatgcaggcttaggacaagagaaggagagccgtgggcaagtactatacatgttgtcctatgtccgaaattggtggaccactttagtactagaatgtttaattttacttttctcaagaaataaaacatcctaaggcagtcctaaaccattctgacttttaaaaaggaataataatgaatctagaagaagtaaaacttccactcaa

SEQ ID NO: 680 - DNA, 661 bp, Homo sapiens
  misc_feature [331]..[331]: Chromosome 5, SNP identification no. = rs11241322
  misc_feature [331]..[331]: allele = g, in linkage disequilibrium with rs2963765, respectively
  misc_feature [331]..[331]: n is a, t, c or g
cggcattctctacagcttgctggatatgaatcatcacatgcatcctgctttcaagcagctgctgcataatcctctgcaggcacagggtggaatgcaggcttaggacaagagaaggagagccgtgggcaagtactatacatgttgtcctatgtccgaaattggtggaccactttagtactagaatgtttaattttacttttctcaagaaataaaacatcctaaggcagtcctaaaccattctgacttttaaaaaggaataataatgaatctagaagaagtaaaacttccactcaagtctatacttttcccactaggttgagaaggtggacanggaggggcagtgtaggcatgggttggagacaagttggaaggatatcataaggaagagaggaaaaagtgcattttgtattgttccagaagccaaaacaaaggaagaagagttagaaagcagcaattttttcttggtataaacaaatgtgtgtttgtaaaaaagggttttttagtgtggtaaaatatatataacataaaacttacaattttcaccatttataagagcacaattcaggagcattaagtaccttgatattgtggtgcaaccattgtcaccatccatgtctacatgggttttatctttccaaacagaaattctgtaccctttaaa

SEQ ID NO: 681 - DNA, 661 bp, Homo sapiens
  misc_feature [331]..[331]: Chromosome 5, SNP identification no. = rs11241323
  misc_feature [331]..[331]: allele = c, in linkage disequilibrium with rs2963765, respectively
  misc_feature [331]..[331]: n is a, t, c or g
ccagccccttggaatcaccattctactttctgtatctctgaatttgactgtttcagctgcctcatataaatgggatcatatgatatatatccttttgtgtctggcttttttttacttaagaacatcaaacattatgatgttttcaaggtccatccacattataacatgtgtcagaatttccttcctttttaaaggctgaataatatgctactttatgtatatactcaatttatctattcatttatcaatggacatttggattgtttttactttttggcaattatgaataatgctgcaatgaacatgggtgtacaaatatctgtctgagtcnctgcttttaattattttattttgggcattaaatatattttctaatgaacttaactagaagaaagatctgtctgcccttgaagtgtagaaattctcctttactggggctaataaagtttctggaaaatgcccagccttgaaagacaccagagaagagaatgccatctctaaataggatatttgactaacctagtgactcttaaaccaggttctacttctaatcacatgagtagcacctagaaattatagctgcctaggaatctgatggacaccacattaacaaggtaattaaacgtaacatcacaaattatgaggcaaactgacatcatgt

SEQ ID NO: 682 - DNA, 661 bp, Homo sapiens
  misc_feature [331]..[331]: Chromosome 5, SNP identification no. = rs2963749
  misc_feature [331]..[331]: allele = g, in linkage disequilibrium with rs2963765, respectively
  misc_feature [331]..[331]: n is a, t, c or g
tagaacgacaatattttgttattttatatctgtgcgtaaacattgtattttcccgtgaatgatatgtttgacaagaggtggaacgaaaagagaggtaatgcctagaatatcttttagggtatagtcgtgtataagtcgattaaaaattctctacatgtcatatatctacaaggtaatatgtccacaagattataactaaattacaagacaattacctgaacatccgataagatctgaaactaaaatttattacgaagtcaatgatagaatatagaaaggtgtgtatgtacttatagacaactcatctaaggatctgcactttaaagactcnccttttccgtacacgtaaattacaaagctaactacaacggctgtagtggagatttctccgaagtagtaaacgtccggatggttgtcacggactttagcggacaaaggggtatcggagacattttatcacgagacagtctgaaatccttgtgacggttagatctgtaactttctacgacagagtcaaattaaaattacagatgaacagaataatactcatcgttgcctggttgagaaatcatacacattctccatcaacatggataaaaagatacttgagagaagtgagtaggaagtgggtaaaaaggtgaccaaaagccattgacgataa

SEQ ID NO: 683 - DNA, 661 bp, Homo sapiens
  misc_feature [331]..[331]: Chromosome 5, SNP identification no. = rs17383865
  misc_feature [331]..[331]: allele = a, in linkage disequilibrium with rs2963765, respectively
  misc_feature [331]..[331]: n is a, t, c or g
ctgaattttaaaaaacgcttataccctattacccaacacttggaatctatcccacagaaataaacaaaatcataaaattattagtacccagtgataattttggagccaattaagaaattaaccaatatgaatttaaaaattgagaggccatgatacaaggtctggtggtctatttagatgtgggatttaatgtcagaaattgtggaaattatgattcctaatagactgtaaatattatgaatcctgatcacgtataataaaatgactaacaaaaaaacagaggataaagagaagcaatgtgagtggataggtgataattctaattattatntgtctcagcaaaatgacttaactcagcctgtgaaatttgaagcatgtagataaaaaataaatttgccaacttaatgctttatataatctcttgccctcccttgcttttcttttttctataaactacttttctaattttatagggctaatataggaaataatatttctgtggtaaagaaacatttatacaactttcatcaacccttcaggttactcagggccatggcacacactggtgtacattgtacactgcccagatctaagaggtgcccctctaggggctgtaacatggatgagggccctatggttgggcagtgctcatccatacaac

SEQ ID NO: 684 - DNA, 661 bp, Homo sapiens
  misc_feature [331]..[331]: Chromosome 5, SNP identification no. = rs2963747
  misc_feature [331]..[331]: allele = a, in linkage disequilibrium with rs2963765, respectively
  misc_feature [331]..[331]: n is a, t, c or g
tcgaattcgttaaatgtgtctaatgtagtaatttagaagtgttgatgacgaactcgatattaataagacaaagtacctactccttcgaccttgtgtttctcctattcagtaaatatgttttagtgagtcgatcaactaccagtttaggtcggtcgttttgaaggtttagacacaacattggtagggtaacatgacaacgagacttctttatatgatccaagttacccggtaaaatatgtaaaatacaaattatcttttcattattgaaatacgaatttataatcttcttttctcttgacatcatttgacaccgacggtacatgtcaacatncctactcgtgacgggttggtatcccgggagtaggtacaatgtcggggatctccccgtggagaatctagacccgtcacatgttacatgtggtcacacacggtaccgggactcattggacttcccaactactttcaacatatttacaaagaaatggtgtctttataataaaggatataatcgggatattttaatcttttcatcaaatatcttttttcttttcgttccctcccgttctctaatatatttcgtaattcaaccgtttaaataaaaaatagatgtacgaagtttaaagtgtccgactcaattcagtaaaacgactctgtatattat

SEQ ID NO: 685 - DNA, 661 bp, Homo sapiens
  misc_feature [331]..[331]: Chromosome 5, SNP identification no. = rs17137667
  misc_feature [331]..[331]: allele = g, in linkage disequilibrium with rs2963765, respectively
  misc_feature [331]..[331]: n is a, t, c or g
aagttattacttttctattaaacataaaatgtataaaatggcccattgaacctagtatatttcttcagagcaacagtacaatgggatggttacaacacagatttggaagttttgctggctggatttgaccatcaactagctgagtgattttgtataaatgacttatcctctttgtgttccagcttcctcatccatgaaacagaataattatagctcaagcagtagttgtgaagatttaatgatgtaatctgtgtaaattgcttaagctgagaagataaatcagcagccaaatatgttcaacctgactgtaacaagagaaagcaaacgaagncctctgctgttcagcattggtttgtgatcctgaaaggggtggctcatttggttatagttcactagagagttccgcccaccttaggaatttgccattgttccaattttccatgatttgaaattgcagtatgaatcttcccacatgaaccttttaaattcccagcaaacacaatcaatagaagaaatcttgcattttgcttttcttaaaaaacattatttttaaagattgtgcatagtagctacttcagcaccatcattctgtagttattaagtaaatgcaaatttttaatatttgtgtattgatctgaggagttttagtgctggtagcctg

SEQ ID NO: 686 - DNA, 661 bp, Homo sapiens
  misc_feature [331]..[331]: Chromosome 5, SNP identification no. = rs2925170
  misc_feature [331]..[331]: allele = t, in linkage disequilibrium with rs2963765, respectively
  misc_feature [331]..[331]: n is a, t, c or g
cgtctgtccgtacgtctactgcccgagtccagtttaccattccccttcgtggactttcgggaccactgtgactcactaagtcggtcttctctattggtagacgcgatttaagacgtttttacgtacacacccaaagacactaccggtggtggttaatcccacaaattataaattccgtacaaattataacattccgtacaaacttgaagtccgggtttctataacctaaaactactatgaaagtgtcgtaggaggaattacttactttagagacttgataagagttctgtcttatttaaacacaagggtccacatttgttatttattacangtgtctttcacggaatgttataacctattccggtacagatgttagacgacaaatgtgaacatagtgaaaaataaccactgtatactcgaattatgtcatttttcgacgttgactcaggacacgtccggtgtctcccgttcagtgttaagtggtctgtggacaaaaaacagtttaaaagtttagttggtgttgtccgatggtcgtgattttgaggagtctagttatgtgtttataatttttaaacgtaaatgaattattgatgtcttactaccacgacttcatcgatgatacgtgttagaaatttttattacaaaaaattcttttcgtttt

SEQ ID NO: 687 - DNA, 661 bp, Homo sapiens
  misc_feature [331]..[331]: Chromosome 5, SNP identification no. = rs2591258
  misc_feature [331]..[331]: allele = g, in linkage disequilibrium with rs2963765, respectively
  misc_feature [331]..[331]: n is a, t, c or g
cacatgcatttttgcagaatttagcgcagatggttatctcttctggctgaatcactcagtgtcaccagggctttcaggtgcttccccttaccatttgacctgagcccgtcatctgcatgcctgtctgcttcccagccatgggctgaaggggcctgagcacatacacatctatgagggatatcttgatatatttttttcaggaaaaaaagtacgcataattcgtaaggctgagttctgcttccttgttcaatgatttcctagggatctatcttctgtatctgcacttgggtatctctcatcaatttgcttaagactgcaggttacaagaagngattgcagctccacttattccaacactcccctgccctcctctttgagaacttaacatttaaaaatcggttttgttttgttaatagctataatattcacacggtttaaaattcaaaaggtacaaaagaatatacagtgaaaattttcccttcttcccccgactcccaactatccaattccctttcagaagcaaccaatgttatcattttcttgggtgtttttcagaggtaccacgtagatatatgtagtctctcccttgatttttagcaactgacttaagtacactatatgtaaagttctatttcatgtttttgtatttgacgttgtgtat

SEQ ID NO: 688 - DNA, 661 bp, Homo sapiens
  misc_feature [331]..[331]: Chromosome 5, SNP identification no. = rs11740600
  misc_feature [331]..[331]: allele = t, in linkage disequilibrium with rs2963765, respectively
  misc_feature [331]..[331]: n is a, t, c or g
ggttacaagaagagattgcagctccacttattccaacactcccctgccctcctctttgagaacttaacatttaaaaatcggttttgttttgttaatagctataatattcacacggtttaaaattcaaaaggtacaaaagaatatacagtgaaaattttcccttcttcccccgactcccaactatccaattccctttcagaagcaaccaatgttatcattttcttgggtgtttttcagaggtaccacgtagatatatgtagtctctcccttgatttttagcaactgacttaagtacactatatgtaaagttctatttcatgtttttgtattngacgttgtgtatacactttatgcaggaaccgtctatctgggaaggttggctcttttttgacagcttcaggagatgcccacagggactagggatggaaaatagactgtctgccaaccgtaaagaaaagtgcagtcaactcttccatatgtggggagacggatctcacagccaggggatcacccttacatcctcctcagggtttaagatcacacggtaacttcccaatgccaaacctagcactggccacctggtaggtctcaatagatgtctgccaatcggtggataagaaaaaaatgttggacctactcaattcacaataaacatgttgca

SEQ ID NO: 689 - DNA, 661 bp, Homo sapiens
  misc_feature [331]..[331]: Chromosome 5, SNP identification no. = rs7715232
  misc_feature [331]..[331]: allele = c, in linkage disequilibrium with rs2963765, respectively
  misc_feature [331]..[331]: n is a, t, c or g
acaaaggttaagccttattatagaacagctgaggttacatggatgacgtcaaaagtccttatatttagaaaccttctcaaattgccttgtgtattgtcagccctctcaatctgtcactactggcagccaccagtggatctggcgtaagaagcctgtggttttgtgtccctcccacaggcccacaaactttggacttttggttctcttgctgactccctgaccccgttcctgaacccaagaaattcactcccatggtggctggcactgcacccccacacccctccctatgttcccttaggtgtctgctttcaggtagcactgaaacagtcanagctattttttaaaatgtaactctcctagaatttagccatgctatgctatcttgctattttgaaagctgaatctattcaatatatattttcaaatatacatttgtctgctctatattcttttacctctacctgctacctattgcttcagatctcctgcatcagacaaattaagaaacaccagattaagatgaccataaagaggagtgtttgtggggatgtagcagaaggcaaagaccaaatgtctcaccgtcattgtcatcttcatcctaaagaaaaggaactaagattgatagtgccggggcctgttccaggctctttttttttttttt

SEQ ID NO: 690 - DNA, 661 bp, Homo sapiens
  misc_feature [331]..[331]: Chromosome 5, SNP identification no. = rs2198712
  misc_feature [331]..[331]: allele = g, in linkage disequilibrium with rs2963765, respectively
  misc_feature [331]..[331]: n is a, t, c or g
tgagacaacaaaaggagtctcccaaagtttatcgaagttcttcacatcgactgagtatcacgacaatgaaagtaaaatgacgaccccgactcgttattcatcatccgattgactccttaaatagtcggtaggtacgttcattgaaagtacgtataaagtccgaaggagaagagggagacttttctcgtaattaaagacggtaggatgggagaccggttgttaaagactgaaccacctatccctacaccgagaaagagggagaagacagacctagtgtttaatggaagtagcagtactcactcacttaaacacgattccctcctgccccctngtgtctaatagggttgagattccatcagtatgtatattttacgattcgaaccgtttatttagataaccttgactaacacatgttatcataatgaaaaaagaaaaacacttctttacttcgtgcgagggaaccacttaaatcttatcctaaactaaaagtttttgactaaatgtatgttggaaagttagtagaagacatgtacaccgacctaattctttcgaaatcaacatgaaggccagactaataccctaacgggaacattcccggaaattcatcagaaacgatttcaaactggtcggtattactctccgtattaacaaatcaccaatt

SEQ ID NO: 691 - DNA, 661 bp, Homo sapiens
  misc_feature [331]..[331]: Chromosome 5, SNP identification no. = rs10477531
  misc_feature [331]..[331]: allele = t, in linkage disequilibrium with rs2963765, respectively
  misc_feature [331]..[331]: n is a, t, c or g
tcccagccagccccagtgtggaaaagcctgggctagcctgctggaaggtgaggagaccacatgaagaaacaacaagttgaccaagaggccaccctatgggtcccagtcaacccggcagacccataattgagcctagtcaagaccagaactgcccagttaggctcagtcgaaattgctgatctgcaaaattgctagctacataaatagtggatgttttaagccacaagttttagggtagtttatcttgcagcacaaactatctgatagagtagctagtggttatttccaagactgattctggaagaatgaatatttgagcaaattggttcanttccaaaaactaagaattgatattgttttccactcccatcttccattttccaatttccaaggcagggatctgagtagatattgagtagatggatatggagtagatattgatactgagtagatgggaagaaatccagaaaaattccacataggtacagttaaaatttcactttaaaaatggctcaagaaaagactgtatagtctaagaggtggacttccaggcaaacatatagaatgagatgtgtgatcaagttgggagtttgtgaaccatgatcttgaaagtccctgtattgtccactgtttaatgttatgctgttttatgggcacaaaa

SEQ ID NO: 692 - DNA, 661 bp, Homo sapiens
  misc_feature [331]..[331]: Chromosome 5, SNP identification no. = rs7703997
  misc_feature [331]..[331]: allele = c, in linkage disequilibrium with rs2963765, respectively
  misc_feature [331]..[331]: n is a, t, c or g
aagattgctggcactgttgccatttcctagaaaaaaagtcactctggtctctggcccaggtcctgacataaacctagttccttttcttctgctgtgatcagtccagataaatttgcacagagcagctgtttctacctgctgctttcatgctgacgaggtatgcattcctctgatctagtgcctgtggcggtttgattagtcataattagacctcagaaatcagactcttttcatctcaatctccaaagcaaaattttctataaattcaacatcagtttatgtaggaccttaaagttaaaacaacaacaacaacaaaaaactccaaagaaancttttgacttcctgataccttttacttctctaatctaaatgcttaggaagcatcaggattaattaggctagttcctgctactcagcagccggaagaagccgaaagaggtggagttttgacctgcctctgaaccttctacatgggcagctggccctgggcaggtgtacataattaacaggtgtgagctggcagggtactcggaaggtcctgttagcagttcccatgcaatcttctgaaagtagggtcttgagctgtcaatgattttcttatatttgcatgagtcaatgcacatgatcacacgtcatttgccatgccagagttgtctctcag

SEQ ID NO: 693 - DNA, 661 bp, Homo sapiens
  misc_feature [331]..[331]: Chromosome 5, SNP identification no. = rs17137708
  misc_feature [331]..[331]: allele = c, in linkage disequilibrium with rs2963765, respectively
  misc_feature [331]..[331]: n is a, t, c or g
gccatttcctagaaaaaaagtcactctggtctctggcccaggtcctgacataaacctagttccttttcttctgctgtgatcagtccagataaatttgcacagagcagctgtttctacctgctgctttcatgctgacgaggtatgcattcctctgatctagtgcctgtggcggtttgattagtcataattagacctcagaaatcagactcttttcatctcaatctccaaagcaaaattttctataaattcaacatcagtttatgtaggaccttaaagttaaaacaacaacaacaacaaaaaactccaaagaaatcttttgacttcctgatancttttacttctctaatctaaatgcttaggaagcatcaggattaattaggctagttcctgctactcagcagccggaagaagccgaaagaggtggagttttgacctgcctctgaaccttctacatgggcagctggccctgggcaggtgtacataattaacaggtgtgagctggcagggtactcggaaggtcctgttagcagttcccatgcaatcttctgaaagtagggtcttgagctgtcaatgattttcttatatttgcatgagtcaatgcacatgatcacacgtcatttgccatgccagagttgtctctcagagagttcacgatatggac

SEQ ID NO: 694 - DNA, 661 bp, Homo sapiens
  misc_feature [331]..[331]: Chromosome 5, SNP identification no. = rs13162208
  misc_feature [331]..[331]: allele = g, in linkage disequilibrium with rs2963765, respectively
  misc_feature [331]..[331]: n is a, t, c or g
gtgaaacaaaactatacaacatgaagaaagaaacaagaatttttaaaaatctcaagagtagatataacacaataaaaaacaatctctggatgtgaataatcaatacgctatcatcaaacagagaaacttaagagctatatggtataaataggagtacttcaaaggaagactttggggacaagaatcatgtataataatattttattagtaagttaaaattttctaaaacagtggatataattctgggaaaagctaaagtaaatgcataaaattctcagggtttccaggcacctgtgtaagggtgtgcatgttttagcagcaactactggcntttcctctttctcttagtagctgagtcattggccagtcaggaacctcactacggaggttcttaattaactgcagctgtgtttaaatattttgctctcaaacaataacaataatagaagcaacaatttaaaaatagtattcatacgcaagctttattgagagctgactatctactgggctctgttccaaccactttatatgtaatacagcattgatcctcactagaatgaagaagtggggactattattgtcctcattttacaaaggatctaagatagttactattcttgagctcagattaacttttaccacttttcaaatgtcagagtgg

SEQ ID NO: 695 - DNA, 661 bp, Homo sapiens
  misc_feature [331]..[331]: Chromosome 5, SNP identification no. = rs751485
  misc_feature [331]..[331]: allele = t, in linkage disequilibrium with rs2963765, respectively
  misc_feature [331]..[331]: n is a, t, c or g
tggagaaaatcagtttggtgcttctgctccatggcaggccagaggcaggaaggactttttaagagttgtgcaatagttaagaaatagatggactcttttcatccatgccataggctcaacatactaccccctgatggttaaaactgcctgttatgctgaaacattccatacaggcaagtgaagaacactggaaattcattccattattccacaaatactgcctgtatcctatgtgtgccaagctctatgctatgctgggaatacgatggtaaataagacctaagacttgctttcaggacatacaattcagtttttaaaagcccccagttanagaagttacaataaagtgttatggcagtcaccaggaaagtggaggaggcatatgatgggtgtcagcctagtctagggatcaaggagttgtcgaagaaacaagctagacactagttaaaggcaataaaggcagattgtgtgcaggaagaactactgcaggaagggaaagagactttagtatagaactgagctcagttctcaatgcagcagacagccggggatttatagccagcaagcagagtaagcagtctgtggatggaaagttactaagagggacatcaagtgttggcggattcttgctaaactggcatcccagaacttgtgataaagg

SEQ ID NO: 696 - DNA, 661 bp, Homo sapiens
  misc_feature [331]..[331]: Chromosome 5, SNP identification no. = rs897478
  misc_feature [331]..[331]: allele = g, in linkage disequilibrium with rs2963765, respectively
  misc_feature [331]..[331]: n is a, t, c or g
aagggagacgaatcttatgtggaagtaggttgaacttagtcgaaattatgaggaaagacgttcgtgagactgttttcgggaaaggagctggtttgaaatttgtcgaggagtctcagaagaaaaactggtccggagtaggaacccgggacaggaaccggacgacttcggacaaagtagttcgtaggaggatcagtcaaatctaagggggtgggaactatagagtggttggaactgtagaccagttcaagaagtagaagagacgattggaactcaagattcagaaaccaggtggaaatagtgttcaagaccctacggtcaaatcgttcttagncggttgtgaactacagggagaatcattgaaaggtaggtgtctgacgaatgagacgaacgaccgatatttaggggccgacagacgacgtaactcttgactcgagtcaagatatgatttcagagaaagggaaggacgtcatcaagaaggacgtgtgttagacggaaataacggaaattgatcacagatcgaacaaagaagctgttgaggaactagggatctgatccgactgtgggtagtatacggaggaggtgaaaggaccactgacggtattgtgaaataacattgaagatattgacccccgaaaatttttgacttaacatacaggacttt

SEQ ID NO: 697 - DNA, 661 bp, Homo sapiens
  misc_feature [331]..[331]: Chromosome 5, SNP identification no. = rs2016888
  misc_feature [331]..[331]: allele = t, in linkage disequilibrium with rs2963765, respectively
  misc_feature [331]..[331]: n is a, t, c or g
tgttctaaatgtcacggaagtttagagagaaaacgaagacagagaccagagtaaaggataggataaacggagtttgaagtaaataggtagtcgtaaaaaatgaaagggtttatatggtacgagcggagtggagattccggaagtgtccacgagaagggagacgaatcttatgtggaagtaggttgaacttagtcgaaattatgaggaaagacgttcgtgagactgttttcgggaaaggagctggtttgaaatttgtcgaggagtctcagaagaaaaactggtccggagtaggaacccgggacaggaaccggacgacttcggacaaagtagntcgtaggaggatcagtcaaatctaagggggtgggaactatagagtggttggaactgtagaccagttcaagaagtagaagagacgattggaactcaagattcagaaaccaggtggaaatagtgttcaagaccctacggtcaaatcgttcttaggcggttgtgaactacagggagaatcattgaaaggtaggtgtctgacgaatgagacgaacgaccgatatttaggggccgacagacgacgtaactcttgactcgagtcaagatatgatttcagagaaagggaaggacgtcatcaagaaggacgtgtgttagacggaaataacggaaattg

SEQ ID NO: 698 - DNA, 661 bp, Homo sapiens
  misc_feature [331]..[331]: Chromosome 5, SNP identification no. = rs1988515
  misc_feature [331]..[331]: allele = t, a
  misc_feature [331]..[331]: n is a, t, c or g
acagaactgtggtaaaaatgaatagtctacttcatagtgtttctcttcttgtaaaccacctaacttactgacagaattttgaactactcagtactgtatcgtcttttcattttaaactccttaatggtacattgaccactgtcttctcgacgttcactccctccgtttacttttccttggtaaataatttatctgtacgttcttttttataaaatgtaagattctaatgtccatgaagttttacgtctaacatccttaatatgtatagacgattttggagtataatactaattctttaaaaatccgattaatcgaggtccctagacgttgnaaagtaaattataaactcccgattttttacatttgagaaaaggaaacaaggggcaaaaatctctgtcctcggtcaccgtgggtatctttgtcttacatctcaagtctttcttgttatttcttcttctagtgtaccacctagttttgtagtccgtctgtcagtcccaatattccgttacatatgggacctctttcaaataattggaacctcgaaatgtaaagagtgacctttttaaattacctactgtcttaagtggaatctcattaaaacactctgtaattacaaagttaagtacatttcaaagatctttttagacggtatatcaacggt

SEQ ID NO: 699 - DNA, 661 bp, Homo sapiens
  misc_feature [331]..[331]: Chromosome 5, SNP identification no. = rs247184
  misc_feature [331]..[331]: allele = t, in linkage disequilibrium with rs10491268, respectively
  misc_feature [331]..[331]: n is a, t, c or g
tatataaaatatgccacaataaagttacaaaaaacatgctaactgatagatagcaagcataatagtactgcatcctgcatgattccatttatataaaattctagaaaaaactgaactgtagtgacagaaggcccatcagtagatgcctggggctggagtttggggaactggctcgactgcaaaggggcacaagcaatgttttttgtgtgaggtattctattttacatcttattttgctggtggttacatggcctgtatactactacccaaattcaccaaactgtgcatttaaattggtgagttttattgtgtccaaattttaccacgaaanaggccaaataatacttgtatgtagttaattctgcaattttgtttcaattattcttagttaacattttttctacatttaaaaattgcacgttctgaagttcttagtgcttctttaagatgtatttaattcacttgaccctaattgttcagataagatcacagagtaagggaaattactggagattctcaatcacttttaaattataaacgtccctgaaattgtcaaaagaggaaaacaaaaaaacatataaagctttcttaagcaaatggcaagattcaaaaatactccaaagtttagtacacattttggcatatcttgcctctcttccca

SEQ ID NO: 700 - DNA, 661 bp, Homo sapiens
  misc_feature [331]..[331]: Chromosome 5, SNP identification no. = rs247195
  misc_feature [331]..[331]: allele = c, in linkage disequilibrium with rs10491268, respectively
  misc_feature [331]..[331]: n is a, t, c or g
tgaaaacctggaggaaatgattgattttccaagaaactgaagtcaccaagaccaactcccataaaaggcagaaatatttaataatgaaaattacctaggaagaaaagcagaatgtgtgtggagtacaatcccttccctgaaggcatcagaataaaattgtttaatggatggaggcgctatgaatgtacactccaaccttgtttaaacttttctaaaacagagagctctgaattcttttcacaatggaagttggcatagccatgatactaaaacctgaacaaaaggatacaaatacagaaaatcaaagatcagatcttttatgaatatttgngaaaacatcctaaataaaaaattgaaaaataacatccaataataatctatcaccaacaaataagatattgttaatataacatcataatcatggtaaagaagaagaaatgatcattttctcaggtggtgagtgaaaaaactaataaaatccaacacccatttctgataaaactcttattaaattggaaaagaagcttactttctttataataccttatggtatttttccagttagaaaattttactatttatgtaatcaggtccatcttagacatttctcactacagtttgaaaatgcatataccccttaagccagaaacattacttctta

SEQ ID NO: 701 - DNA, 661 bp, Homo sapiens
  misc_feature [331]..[331]: Chromosome 5, SNP identification no. = rs247210
  misc_feature [331]..[331]: allele = a, in linkage disequilibrium with rs10491268, respectively
  misc_feature [331]..[331]: n is a, t, c or g
aggtaagcgcgactatttcagttttacattcactataatggaggtttagagacccagagacatcaaggaaattgcccgtggtaacaggtcataagtggcagtgtcctaatgtttgcccaacttatcactcagctttctcttttttgtgtctcaaaataacttacagcaacttcttgatctggaccctgcagaccattcattcattcagagtgaactaacatttatggagcctctgtcacttgagaggctttgagccaggcacgagggatagggtgtgaacagagtggacacatccctgactgaataaaggtctttccagcctcatctggtnctactctccataggcagcaaatgctctagccacaccataggacttgaagttacttaataacatccagtgtcccttcacctctgtttctgtgctgttgcttctgccccaatcccctaccctgtggtcctctgctttgctggctgctactcaccattcctgattccgtgcctagatcactgctccatgcagccttctttgaactccctagttagagttagatccctttcctctatatcagagctctcacatatgtcaaatgccaccatgcctgtctgcttatgtgttgtctgtggctgctttcatgctacaatgggagacttgagtaattgc

SEQ ID NO: 702 - DNA, 661 bp, Homo sapiens
  misc_feature [331]..[331]: Chromosome 5, SNP identification no. = rs247094
  misc_feature [331]..[331]: allele = t, in linkage disequilibrium with rs10491268, respectively
  misc_feature [331]..[331]: n is a, t, c or g
acttttaatggtcatgtgagactctctggggcccaataactcagtggccaccttttctggagagttctgctaactagactgcacttcacaccacactactcatgagcattgattcagtagttcatgtgatgctacagtttagattctgtacctctgcatatccatcaaagatgccacagcataggctgtggcttggctgccatagaccctccacaaaccatggcaaagtcttttttttccttcctcccattcccttctacctcaactagcctcattatcacatttggcctgagtatatgtgaggaggtaggggactagaatctcacttganatcatgcttttctttttccttgtacttaccaaagttgtaactatacattttttatgtgattaccttttttaatatgtgcctcctttactagatgataggttccacaaggcaagtaaatatgtttgcttgatcagtgtctcagtcattttgtgctactataacaaataccacagattaggtaattttaaaaaaaaagaagtttattttgctcatggttctggagtctgggaagtccatgatcaccacactgtcatttggcaaaggcctttgtgctgtgacagccaatggcagaaattggaaggcaagagagggttaagagagagcaagcaa

SEQ ID NO: 703 - DNA, 661 bp, Homo sapiens
  misc_feature [331]..[331]: Chromosome 5, SNP identification no. = rs10074635
  misc_feature [331]..[331]: allele = t, in linkage disequilibrium with rs10491268, respectively
  misc_feature [331]..[331]: n is a, t, c or g
ttagcctggtgtctgctatcttatcagtgtataattattactataaattacttgctgatttttaaaaaagagacagggtctcgctacgttgcccaggctggactcagactcctgggctcaagttattctccggcctcagtctcccaagtagctggaactacaggtgcatcactatgattggcttattgctaaatatttttaaaataaaaaaaatcacatgctcatcaagaaagatgattcgttgtcagagttcttttcagttttaacatgttgacatctcaaataatgatatgggaagtagagttgcttaggtatgtaaaacggcatttcnccatctgcaagaaagaactaaattaccttccagctttgtaagtgagttctgttcacaagccattaagaggtaacttgtggtttatatcacaggtgacatcagggatgaaggtaggggactcaagggcctctccagctgctgacggctgacctgagagacagaaaccagtatatctttcattctgatgaacatagaaaatgaacaatctttatattgtaagcctaaacacaagtgctttaataatgtatgaaacatagtaataggaaacaaaaacaaaacaaaagaaaaaaaaggaagtcccatactttcccctaaagatcggccttagac

SEQ ID NO: 704 - DNA, 661 bp, Homo sapiens
  misc_feature [331]..[331]: Chromosome 5, SNP identification no. = rs10061806
  misc_feature [331]..[331]: allele = g, in linkage disequilibrium with rs10491268, respectively
  misc_feature [331]..[331]: n is a, t, c or g
accaactcattcttatttgccaagggcttccctggatttaacaccataaatcccatgcccaggaaacctttgtggcaaaccaagatgactggtcacactaactgaggtggtttctatacctgcataggaataggctcttcgtgaacaacaacaatcattgaaataacaataattgaaacctgtctgcttactgaaaaccaactacttaattgtcttatatggataccttcacaagaacaccttgaggggagtagtagtattttacttctgtttctatacagaaaggaagatggatttttcaacagttaggtattttcccccaaaccacacnggtactaagaagtaaaggtaagatttgaacccaagcagactaattacatttgttcagctactacaccatgccgctctctgttgcaatgctcccttctgacaaaagcagtcacaggcagctcatagccatagtcaccatgatgtgttaatttcaactgtgccttcctggtaaaagctgattccaccaaaaacgagggcctgagacagaaaccagtggtccaacaggacatttgtcatgggagttctctgctaataactggttgcttctttactttgctttgtatcctttgcacctgaggtaaactgagtatatcattcttccttgctcatt

SEQ ID NO: 705 - DNA, 661 bp, Homo sapiens
  misc_feature [331]..[331]: Chromosome 5, SNP identification no. = rs7449021
  misc_feature [331]..[331]: allele = a, in linkage disequilibrium with rs10491268, respectively
  misc_feature [331]..[331]: n is a, t, c or g
taatgcacatgacatttgtctcccacttggcagtccattatcattgtgttagacttcaactgcctttgaaaagacccatctgagttggcacttttatggacccagctttcttttggactcagttaaaccgaaggatggtacctcctctttaggtacttaaaacattgctcatgttggacaccaatctcagtgcccttgagaagtgtatacccctctgtgcttttaattagatattgctcttttttttgcctcagaaagagcctttcttgacttcccttcaaatagttgttgcccctccaataatcttttattttgtctcaaaattcttagngaaagtcttactaatgaggacatgagatttgcccatcattggggtggcattttctatatatatatatatttactacatgtctaccagaaatggaaaattaatctcagacacttaaaatttctgaatatttgaaattctccccaactccttgactaagtctcacatgcatggtgttatgacaaaattcaaagaatgtaaattttgcaactcttataaatatatagaatttaaaaacctataaaatcatattattcattattaaaggaaagattattgaggccctcaagatccacaaagtcaattttgggagtgttacttagcctatatttt

SEQ ID NO: 706 - DNA, 661 bp, Homo sapiens
  misc_feature [331]..[331]: Chromosome 5, SNP identification no. = rs17163935
  misc_feature [331]..[331]: allele = c, in linkage disequilibrium with rs10491268, respectively
  misc_feature [331]..[331]: n is a, t, c or g
atgagagatcaaagacaacaccttactttctagtaagagcaactggatgaatcatcaaaagtgaaagggaaactgacacattagatacataaatacattgttaaaattttagttgtcccatagttatgtggacaaggtccttagttatcaatttcactttacatgagtttataaaatcccccagatttaaatgataatattgttactgacccctgatgttacattcttcggttgcaaataacagaaactactcaaagtacttcaagtaaggggagttttattatacagatttacgggaaaatgagaaaaataggtttctcagtcatggtgnttgggcctcacagaaatctgggtaaacctgcttttaggtacttaaatttggctaatgttggacaccagcctgggtgccttttagaggaagaggaggactgatgtccagaaaacactttaagaaatggaaggccattcaggaatccagtgctgctttttcaataagttgttattattttggctctcttattagccaatgagaatcagccattcttttcatctctactttatgtttattcttcctctttcagtttcctagttgactcctgaatttccctactcactgactctttctcagagttctcaattctaattcctgagagattcctgt

SEQ ID NO: 707 - DNA, 661 bp, Homo sapiens
  misc_feature [331]..[331]: Chromosome 5, SNP identification no. = rs10491268
  misc_feature [331]..[331]: allele = a, g
  misc_feature [331]..[331]: n is a, t, c or g
tgctattaatctctgtggtttactacttagagaaagatattgtccttaaaaatgcaatcccaagatcctttggccaacgacacagcagatagtacccagagaggcatattatggttgtaactggcagcggggctaataggaaaaactcttgaaggtacagagatggatacgaaaaacaaataggtaagttgattgtttgagtgggtgaaaattgttctgttaatgacatctaccattttcattgtgctaactttcctgttttctttaactgaaatcttttttctagagcagttaacaaccattgtgtacttttacaggaaaaaagccttcnaagactggcgaacaaagatttcagtttttgtgtgaagtctaactttcccaggaagggaaaaagccaaaaattttaacctaaccgaacataaactagtgtttcttttttcttccctctaagcatattcagagtccacaccatttctaatgcaccactggggcagaatgtgtaatgactaatagcctggcagagacccaggtgacatgtgaacactgcgccttggccatagccagttagcctggagcagacgccaaagtttattgtctttgcagtttcctggccttcgccagtaagaagtcatggctctcaccagactttttagctaggcta

SEQ ID NO: 708 - DNA, 661 bp, Homo sapiens
  misc_feature [331]..[331]: Chromosome 5, SNP identification no. = rs17790915
  misc_feature [331]..[331]: allele = a, in linkage disequilibrium with rs10491268, respectively
  misc_feature [331]..[331]: n is a, t, c or g
ccatgtatccctctgtttgtcattatatttttgcttacaaacagacacagggacagggaaaggtatttataaactctgctgtgtgtcctgaagttaccatgccatagcgggagaatgctggggactcacaggcctgggtgtctgaagaaaagtttcatggtggaagctgctttactcaagtctcctttttgggcttttgaggtcatttaacagttgtcaggtacaggtgggaaaacaaaatcttgttctgatccacttttagttcattgtctttaatcattactgccatagagaggtctcttgtccagctcagttcctcagatagacattngggagaaaacttcccttgggcacgtgtactagctacttcctgtctaatctttcaggtttcaaatttccccacctatcttagcaacagacctggggtgaagctgcccaaagtcttttaggtgtaacagggactatggcagttcacattcaggattcacttttaagtacataggatgccttgtgatagaatttaggagtctagtagagtcatttaggattctagaattcttgtgacttttttttctttcccacataggcatttagatgctattgtttaaggttttgaaagacttagttataaaatccactactttcacctgaaattgatcta

SEQ ID NO: 709 - DNA, 661 bp, Homo sapiens
  misc_feature [331]..[331]: Chromosome 5, SNP identification no. = rs1496344
  misc_feature [331]..[331]: allele = g, in linkage disequilibrium with rs10491268, respectively
  misc_feature [331]..[331]: n is a, t, c or g
ttgtcctgggacatcccttccaatcaccctggaagtctgttctttaatccatatcccctgaaggctgaatcttctttcttggtttacaaactttattttagcagtccacatgctccagtagctcagcaagagttcatatgaggtacagttatttttttatatactttagtcttcctgagtatcttggtttaggttagaaataattttctctcataatttcaaaggcatctttcttgtcagcaccttaaatagtacctggttcagagcaagcactcagtaaatcattgttgaatgaattattttctagcttacagtgttgctgttttgaaangtgcaattccatatgccattttaatgactgctcttttatattaccctgtttttctgtctgggaacttagcatctcctcttcatctcaagatatttgatatttcagaatgatttgcatgagtatagatttaaaaaattattctgctatgcatcagtgggcctttttatacagtgatctagggtgttttattatggaaaattaatatttgtattcattccctttttgttattacctttcctttagtctccctttctaaattttctaatagtaaactatggaatttcttgaatagattctaaaattttttattccttttctcatactttctat

SEQ ID NO: 710 - DNA, 661 bp, Homo sapiens
  misc_feature [331]..[331]: Chromosome 5, SNP identification no. = rs1019137
  misc_feature [331]..[331]: allele = g, in linkage disequilibrium with rs10491268, respectively
  misc_feature [331]..[331]: n is a, t, c or g
aaatagaacaatgagggcaaaagcctgagtgcagcatgatcaggaatgagcagggaaatgggtattatagcagaggttgcagtcgactcattttgccatgtagtaaagcagaaatgaagctacgggggctggaatacagtgtggtgtatacagatgtttttctggaagactggctaaacaaatgcttcccagagaatggcagtacctagcaaaaactgtgaaaacaaagtgacttccaggtatgaagagctttaagagatgagacatagcataagatttatgtaatgtgaagttttcataaaaaaatacaatattgattataatgattgtncctaaattcataaagtttgctgtgaggcaagctcatgcaaaacagaaagtgaattttgatatctcaacttctgatgtgtttctcattaaactcaactactattaatcaatatttaattatcctgacttttcactcaggatataatccacaattttctgatacaaagtgctttcaggtgttgaaagggcagttccttagttgataaacccttatcttgaatgtgactgagtgcagttcttaagtgtgtgagccacttactcctgtaataatctgtctcaagctgctttctttagctctttcaacatttgaccttaattattcaagatcagc

SEQ ID NO: 711 - DNA, 661 bp, Homo sapiens
  misc_feature [331]..[331]: Chromosome 5, SNP identification no. = rs7735162
  misc_feature [331]..[331]: allele = c, in linkage disequilibrium with rs10491268, respectively
  misc_feature [331]..[331]: n is a, t, c or g
cactgagcctttcacacgctcttctctcatctggaatgttcttattgccctaaacccttctccacctgtgcctagttaactcctaatataatttatgtctccggtaaatactgccaatgctatatcttaaccatataagttgcttcaagttaattttttcctggacattttatgaaatctgggatgcagaaatcatacagtatcctctgctctccttgtgacagccttcctgggttcactggcttgctgtttttggctcccagctggaaaagtaggactagcattcatttttatttcaactcatattgggaaagaaatatgatgtcagctngctttctaattgtaacaaaattctctgcggctgtacttaaatattacaaaaaggtaatgttactttgtacaactatgtaacaaacttactaaatctctcttagaaagtatttcagatgccagtttgtgaaacatcagtgggtgtttacaaggaataaagcatagcacaaccaccctggccattcttaactgtctgacagattcaataccaggaagaacactgggaaaagcctttcttcttcttttttctctttcccagggcacagagcttcatgcccataagggatcctctatcctgatgatcctatcactacaaatggattattttgaa

SEQ ID NO: 712 - DNA, 661 bp, Homo sapiens
  misc_feature [331]..[331]: Chromosome 5, SNP identification no. = rs7707454
  misc_feature [331]..[331]: allele = g, in linkage disequilibrium with rs10491268, respectively
  misc_feature [331]..[331]: n is a, t, c or g
gtgcagggatgcctgagtctgtagccaagggttgggcagctatagctgcaggggggcagtggggctcctgcaggtctgcagccctggtttgggtggctgcagctgtgcctgggagggcagggctgctgcctgctcccagacccccaagagcacagggaggcttggatcttcagccacaacttgggcggctgcagccccacccaggaggacagggctcctggccactctgtggagtgtgcagccctagccacacctctctgaatcagcctgggtgatggcagtggcaaactgtctggagcagccactgctatcacaagcaacatcatcaacntaaaagaatattaaaaacacaacattgaatacaataatcaaatcacaaaggataataggcactgaatttagctttgttttgctagttcatggctcctaaggtatatagtatcagttagaccttgcaaagttacattgtttattttggcaatggaatttcatgtatacttacagatctttaggaatgaaattatctaaccacggcttcaaaaattctgttctttgtggtggaaactgatctttctaatctatggttatttttagaaatgttgttctgaatgatggtagtgatcacaaaattgtctgccagcagccttaaggtctttctgtt

SEQ ID NO: 713 - DNA, 661 bp, Homo sapiens
  misc_feature [331]..[331]: Chromosome 5, SNP identification no. = rs2310808
  misc_feature [331]..[331]: allele = g, in linkage disequilibrium with rs10491268, respectively
  misc_feature [331]..[331]: n is a, t, c or g
ggagtgcagtggtacaatcatggttgacgactcactgccacctcgatctcccaggatcaggtgatcttcctacctcagcctccctcctatctggtactacaagttcctaccatgatgactggctaatttttgtaatttctgtagaactgaggatttgccatgttgctgaggctggtctcaaactcctgggctcaagcaatccacctaccttggcctcccaaagtgttgatgctttgttgttagtcacatatatgtgaaagattgttatgtcttcgtattgacccctttttattatgtgatttcacttttattcccaatagctttcctgctntaaagtctctaaagtctgctctaatattaacatagctactcccactttcttttgattagtattaacaagggatatgttaacatgggataatacattcttcatccctttattttatttattatcttttggggcaaggtctcactcttgtcacccaggctaaagtgcagtgacacgatcatggctcactgcagcctcaacctccctggctcaagcgattctcccacctcagcctcccaagtaggtgagactacaaacatgtgccactaatttttaaaaattcattgtagacatgaggtcttactatgttgcccaggctggtctcaaattcct

SEQ ID NO: 714 - DNA, 661 bp, Homo sapiens
  misc_feature [331]..[331]: Chromosome 5, SNP identification no. = rs10066082
  misc_feature [331]..[331]: allele = g, in linkage disequilibrium with rs10491268, respectively
  misc_feature [331]..[331]: n is a, t, c or g
ccccgtctctactaaaaatacaaaaaattagccgggcgtagtggcgggcgcctgtagtcccagctacttgggaggctgaggcaggagaatggcgtgaacccgggaggcggagcttgcagtgatccgagattgcgccactgcactccagcctgggcgacagagcgagactccgtctccaaaaaaaaaaaaaaaaaaaaaaagctgtctagacctcactagatagtgagacattaggatgaatataaaacatcataatttgctacaaattttgctaaaagcataaataatcacagtctctatgttattaggaaacaaaacttagcaagttttnaagatttatagtatgcaggggctttgttacctccaaaaagaaaggggagcttctctagaagaatgctttctggaaaaaaaaacgacctctcagcaatagctaacatgtcagcagcctcttcctctgtgcagagaaccctgctgagttccttgtgtgcattattttattctctcatcacaaaattcttgtggactatttatcatcactaccatttcacagcaccaaggtttagaaatgttcagacttgaccaagtttatacagctagaagagtacttgattttgaatattgctgcctgcccacttaacatggttatgagtaatgtgagcag

SEQ ID NO: 715 - DNA, 661 bp, Homo sapiens
  misc_feature [331]..[331]: Chromosome 5, SNP identification no. = rs10058629
  misc_feature [331]..[331]: allele = t, in linkage disequilibrium with rs10491268, respectively
  misc_feature [331]..[331]: n is a, t, c or g
tgacctgtcaaccccaaaaggcctcagtttcctcttcttgctcagttcttaggtttttgtacatttctcaagatgtaatatgtcaacatattcttaatgccccaccttgtggcctggcagaaagtaaggtatttatttttcttgagaaactcacccaactctggcacagttttgatatcaaactcaggtcagctgagtggataacaccagcactcaactggctcaattcacaccagccaacctaattaagaagaaactaaagactgttgtttgtgggcttaaaaagacaaactaatggggtgaattaattaattttgaggatcaaacgttnggaaataatgataataatgcatgagtgttacgatttgcatttatcctgcagataagttttctggtatttgcacaggcatgaaatgaattaggtaaatgcattttccagatcttcccattgttttaaagcatataatagcatttcaatttatatagtctagacttgttatctcatactgctattaagccatcaaactcacagaatttcccaagccacagatttcccttttggccattttcactcaccagttctgtcccaacaaacaaagtgtacattactcatagatttgagacatgagtagagagtgaagttaatattgttggatgactc

SEQ ID NO: 716 - DNA, 661 bp, Homo sapiens
  misc_feature [331]..[331]: Chromosome 5, SNP identification no. = rs17678073
  misc_feature [331]..[331]: allele = g, in linkage disequilibrium with rs10491268, respectively
  misc_feature [331]..[331]: n is a, t, c or g
ctcacaattcaaaataattccatgatgactcttttttatggtacagaattcttttatggtacaaataatcatcttcagtttatttttcagtcaatctaagttttcacatattgactttgcttaattcacaacacagctgtgtttatggagaaaactgaacttttgtagatgagtaacattatcatcattcattttctccagactatgaagaataggcaaagatgacagctatgatccttcaggcttgccaagagcttaccagagtgatcttttataaacatgagatggatattttccctaagacacacacactttcagttcctttaaaaanctttccatgaagcctgagccagggaggaaagacagataagactgctgtccacctctatctgcctcctgtcgtccttgcttccttcacacatcctcacctctaagattaagagagaagctaatcaatattttttagagtctctcaaattagaagtggccactttctgcagcctcttcagcagtcccaatatggctctcggttgtttcatggggtcatcagtcttaaaatagagtgagacctggtggtacaggtttgataaattttgctcggtaaactcagcagatttacctatctactgaaggtagaccataatattaggcaacttaagac

SEQ ID NO: 717 - DNA, 661 bp, Homo sapiens
  misc_feature [331]..[331]: Chromosome 5, SNP identification no. = rs2214369
  misc_feature [331]..[331]: allele = t, in linkage disequilibrium with rs10491268, respectively
  misc_feature [331]..[331]: n is a, t, c or g
ttaactagaaggtgtttttaattagaaggtgtttcagttgtttttgttcgttatctctttcctgagggatgagttatttacgaggaccctattgaccgatcggtatacgtcttctaactttgacatggggaaggaatgtggtatatgtttttaattgagttctacctaatttctgaatttacattttgggttttgatatttttgggaacttctattggattctttatggtaagacctgtgtccttacccgtttctaaagtactgtttttacggttttcgttaaagttgttttcgtttttaactgtttaccctggattgatttgttttctanaaaatacgtcgttttctttgatagttgtctcatttgtctgttggatgtcttaccctcttttataaacgtttgatacgtagacagtttccaaattatgggtcttaggtattccttgaatgtaaatgttctctttttttttggaatagttttacacccgtttcctgtaattatctgtgaacagttttctgtatgaacgtcggtttttcgtatactttttttcgagttatagtaactcggggtctatcctccccgtggagagagaaagaatgtggatcctaaacgttacgtttaatttctttacgtttaattttggtgtcactcaatgagaga

SEQ ID NO: 718 - DNA, 661 bp, Homo sapiens
  misc_feature [331]..[331]: Chromosome 5, SNP identification no. = rs6860974
  misc_feature [331]..[331]: allele = a, in linkage disequilibrium with rs10491268, respectively
  misc_feature [331]..[331]: n is a, t, c or g
atattcttattttttttgcctagactgtaaatactagcttcctgagttgtgaaaggaagggttaaatgagcattcttacatcttgtgagcttcttctagcagccaaaccaccaacttgtagttccagattacagatccaatctgttgcatatgaatgataactttggctgtattgctgtgttctcaagccaatctttcaatcattttattctctaatccagtttgtatggctatacctggctaattcaccttctaatttccatatcagcagccaattatgtggattgttccactatagccaaaagatttgagtcactttatagcattaaangtaagtgaaaccaaatcgactcacaatcaaggcttattgattaaatttcaacatttgaaaaactgtgtgttttttttcctttttttttttttggacacagaaccccctttacagatagaaacgaggcaatgaccaaatacagaagagagtgtgggttaataatgtttttttttttaaagctaaattgtctaagaaatgtttctaaattgagtgcttaaaatagaaaataattcttcaactcaatggaaggattgaaaatgttgccaaatccttgtcattttcaccaactgagaaccaggagattaaattaagaagaccatacaaatgttg

SEQ ID NO: 719 - DNA, 661 bp, Homo sapiens
  misc_feature [331]..[331]: Chromosome 5, SNP identification no. = rs10050439
  misc_feature [331]..[331]: allele = c, in linkage disequilibrium with rs10491268, respectively
  misc_feature [331]..[331]: n is a, t, c or g
tggacacagaaccccctttacagatagaaacgaggcaatgaccaaatacagaagagagtgtgggttaataatgtttttttttttaaagctaaattgtctaagaaatgtttctaaattgagtgcttaaaatagaaaataattcttcaactcaatggaaggattgaaaatgttgccaaatccttgtcattttcaccaactgagaaccaggagattaaattaagaagaccatacaaatgttgaggcttcgtggatattaaaaacagccttgagagaaatgaccataaaacataattttgaactcatattggatgggggacactggacaggttanagagatgtggtgtatggcacagcatgcatttcggcatgagtttgttgggactgaatggtgatgagtaaaccataggaacaatgagatggaagggaagatttagagagtaggggatgacagcttagagcattatcaacaagaggctggaaagtgattcaaatgtcagagatagcgtgtatctccatttgctggtaatctaattggctataccatacatacacattcattagaactttgtatttaatatttctaattgctccatctgacaacatattatctaaaacagcaacatggagcttcccctccaaatgcacctgctatacccaaata

SEQ ID NO: 720 - DNA, 661 bp, Homo sapiens
  misc_feature [331]..[331]: Chromosome 5, SNP identification no. = rs7723679
  misc_feature [331]..[331]: allele = t, in linkage disequilibrium with rs10491268, respectively
  misc_feature [331]..[331]: n is a, t, c or g
cagacatccctatggaagacagaagagggcacgttatggtgaccaagggcttgcttagaagcacaggtgagcccaacccctgattcccagaaataactctctgtatgtgtgtgtgcacactgggcatgtagccatgtaataattcttacatgcagccatgtaagaatggctaaggtgaaggatgaagggtgaaagttcctaaagctgaccagtcaggaaagaagcaacattaagcaaaggttaacagtgtctcacatagctaacataggctgactctaaacataatgaaaggactacactagaagataaccaacttagggtctagaaatantcttttgactcactccctccacccccattgctcgtttcctggtttttgatcactccctcctctctgagcactcttttccctgggtttccaggacaccacatattccacgtcttgcccctgctcccctgattatttgttttcagcttcttttgctggttcctttgcccagcttctaaatggtaaagtgttccaggactcagtccttgcacctcatctcttctttgtctacattcccttcgttggtgattttgttccatctcagggttttaaatttcacctatacacttataattcccaaattcatattcccaacccaggccatttccctga

SEQ ID NO: 721 - DNA, 661 bp, Homo sapiens
  misc_feature [331]..[331]: Chromosome 5, SNP identification no. = rs7723683
  misc_feature [331]..[331]: allele = g, in linkage disequilibrium with rs10491268, respectively
  misc_feature [331]..[331]: n is a, t, c or g
ctatggaagacagaagagggcacgttatggtgaccaagggcttgcttagaagcacaggtgagcccaacccctgattcccagaaataactctctgtatgtgtgtgtgcacactgggcatgtagccatgtaataattcttacatgcagccatgtaagaatggctaaggtgaaggatgaagggtgaaagttcctaaagctgaccagtcaggaaagaagcaacattaagcaaaggttaacagtgtctcacatagctaacataggctgactctaaacataatgaaaggactacactagaagataaccaacttagggtctagaaatactcttttgantcactccctccacccccattgctcgtttcctggtttttgatcactccctcctctctgagcactcttttccctgggtttccaggacaccacatattccacgtcttgcccctgctcccctgattatttgttttcagcttcttttgctggttcctttgcccagcttctaaatggtaaagtgttccaggactcagtccttgcacctcatctcttctttgtctacattcccttcgttggtgattttgttccatctcagggttttaaatttcacctatacacttataattcccaaattcatattcccaacccaggccatttccctgagctctacaa

SEQ ID NO: 722 - DNA, 661 bp, Homo sapiens
  misc_feature [331]..[331]: Chromosome 5, SNP identification no. = rs10079808
  misc_feature [331]..[331]: allele = c, in linkage disequilibrium with rs10491268, respectively
  misc_feature [331]..[331]: n is a, t, c or g
ttttgctcttgccagttcctctgcctggatgccctttcttgagatgggtactacttcctcccctctttcagatttttgtttatgtgccacctactcagggatgtcttccaccataattaatttgcaactacttttcacaccaggaattcactctctccttctcttctttattatctttcataacatttatgactacctagcacactatgtattttacttttctgttaattttctgtctcccctcaccagaaagttagggatttttgtctatttagtttactattgtttctattgcacctggaacactgactggtacattgtacctctccantatagagcagctcaatgtttgttgaggctgaatacatgttaaaatgccactctttggaaggggttttcctctccctgcactggtattagcctgtggccaaggagggaggtatgggcttaatggccaatacagccactaggcagggtccaggaaaaggtaacagattgtcagaaagaggaagcaggcaagcaccaaagaaaacccttgccttctcttcccactgtttatgcagacaatgcattccagaggctactgtgatggtctgcaagcgatttccaactgagctttatttcagctaagtagccaagggtaatctgaataaaagaaata

SEQ ID NO: 723 - DNA, 661 bp, Homo sapiens
  misc_feature [331]..[331]: Chromosome 5, SNP identification no. = rs1363170
  misc_feature [331]..[331]: allele = a, in linkage disequilibrium with rs10491268, respectively
  misc_feature [331]..[331]: n is a, t, c or g
agacatatcattgtaagtgattctcagtcacaaactgtttgacagaacggtcgtagtaatcaccttacaagtaaaaccgtgtttaacagataccttttacgttaatcctttttcaacacgttcatcgttaatctttcacttattgaacggaataaagaaaataagtctaatgggaaccgatgaatcgactttatttcgagtcaacctttagcgaacgtctggtagtgtcatcggagaccttacgtaacagacgtatttgtcacccttctcttccgttcccaaaagaaaccacgaacggacgaaggagaaagactgttagacaatggaaaangacctgggacggatcaccgacataaccggtaattcgggtatggagggaggaaccggtgtccgattatggtcacgtccctctccttttggggaaggtttctcaccgtaaaattgtacataagtcggagttgtttgtaactcgacgagatattacctctccatgttacatggtcagtcacaaggtccacgttatctttgttatcatttgatttatctgtttttagggattgaaagaccactcccctctgtcttttaattgtcttttcattttatgtatcacacgatccatcagtatttacaatactttctattatttcttctcttcctctct

SEQ ID NO: 724 - DNA, 661 bp, Homo sapiens
  misc_feature [331]..[331]: Chromosome 5, SNP identification no. = rs13360809
  misc_feature [331]..[331]: allele = t, in linkage disequilibrium with rs10491268, respectively
  misc_feature [331]..[331]: n is a, t, c or g
tgactccaaagtggcgctccctctcattactgggcccctgcacatgagtgagtgtatgcccttggaatgctggcaaaaattttaatctaagaaaaacgaccaggagacaaaaactcctgcaaaattacccagagagcatctcaagtcaaatataaatttttaattttcattaactgccctcgtgcgtgatcagcaccgaactccacttcttcaatgacacaggagagctcagtcttcagcccaggggtcctgagttgagttgctgggcttgttctgagatgagtgtcttaaagtctgagaactgacacttcacacgtcctctatgccaacnggtatgatttaattgaggaattttagacccatagagagacaggaacttttgcaagatgtgatggaatctaaatggaacttggaatcacacaaaattgggaacaaaggagagttccatcagagaatggcattgcacttatttgctaaactcctctgcaattaattttactgcgctattaaaaggagagatagccctggcctgtggttttgaggagtagtaaatgagacgtgcctggaaagagcttcatacattgcagtgccctgtatttttcttcttgctcactcgggatcacacagtagtgggctgggccagacttaaaacatagttctg

SEQ ID NO: 725 - DNA, 661 bp, Homo sapiens
  misc_feature [331]..[331]: Chromosome 5, SNP identification no. = rs13356389
  misc_feature [331]..[331]: allele = g, in linkage disequilibrium with rs10491268, respectively
  misc_feature [331]..[331]: n is a, t, c or g
ttacccagagagcatctcaagtcaaatataaatttttaattttcattaactgccctcgtgcgtgatcagcaccgaactccacttcttcaatgacacaggagagctcagtcttcagcccaggggtcctgagttgagttgctgggcttgttctgagatgagtgtcttaaagtctgagaactgacacttcacacgtcctctatgccaaccggtatgatttaattgaggaattttagacccatagagagacaggaacttttgcaagatgtgatggaatctaaatggaacttggaatcacacaaaattgggaacaaaggagagttccatcagagantggcattgcacttatttgctaaactcctctgcaattaattttactgcgctattaaaaggagagatagccctggcctgtggttttgaggagtagtaaatgagacgtgcctggaaagagcttcatacattgcagtgccctgtatttttcttcttgctcactcgggatcacacagtagtgggctgggccagacttaaaacatagttctgtctttgagttcagtgttttattcctatcaccttaactttgttgcaagtggagaaactacagggcagaaagggtgtgcacccacctcttccccccttctataggacccataaaaaccacactgac

SEQ ID NO: 726 - DNA, 661 bp, Homo sapiens
  misc_feature [331]..[331]: Chromosome 5, SNP identification no. = rs17678190
  misc_feature [331]..[331]: allele = g, in linkage disequilibrium with rs10491268, respectively
  misc_feature [331]..[331]: n is a, t, c or g
acgtcctctatgccaaccggtatgatttaattgaggaattttagacccatagagagacaggaacttttgcaagatgtgatggaatctaaatggaacttggaatcacacaaaattgggaacaaaggagagttccatcagagaatggcattgcacttatttgctaaactcctctgcaattaattttactgcgctattaaaaggagagatagccctggcctgtggttttgaggagtagtaaatgagacgtgcctggaaagagcttcatacattgcagtgccctgtatttttcttcttgctcactcgggatcacacagtagtgggctgggccagncttaaaacatagttctgtctttgagttcagtgttttattcctatcaccttaactttgttgcaagtggagaaactacagggcagaaagggtgtgcacccacctcttccccccttctataggacccataaaaaccacactgacactgcccagagaatggagaatgatcactttgcaaaagagatttctgggatctctgcaaaggtcccagtcctttgtcctgctttcatgtttgcagtgagctctcacacttgcctttctgaggttgagagggagtttatcatccagaataagagataggaaccggatcagattgcttaggttcagatacta

SEQ ID NO: 727 - DNA, 661 bp, Homo sapiens
  misc_feature [331]..[331]: Chromosome 5, SNP identification no. = rs17616306
  misc_feature [331]..[331]: allele = c, in linkage disequilibrium with rs10491268, respectively
  misc_feature [331]..[331]: n is a, t, c or g
cggatcagattgcttaggttcagatactagctccacctctcattactttcatggcctcagtcaagttatttcagctcactctgcctttgtgaccccatctgtaaaatggagataaaagcaatacttaccctattgggaggtatagatatgtatacagaaaacacttagctaataatattactatattataaagaaaatcagtgtataggtagtgcatgtaatgttacctagagaagacatgcatcatggaataccagcactagacttgtttgtttatgtggatttgtcttggtttggcagactttaggatactgtccatcttcacaaagtntagaagtcctgtcttattcttgggtataaagcagcaaccctatatggactgctaagagagactgacacttagctcttgctcctccctcccctgccctctcctcctctcatctccacttctcttccattctctcttcttcattttccttcgtcctcttccttttcctttctctttccctccctgtctgtccatctgtcccttcctttctcaatctccaacccttcctgcctttcattatctaataaaaagccggattgttttttccttggcatcctactcatcttcatttccctacaccttgtcctccctgcccctactgttccctgcagt

SEQ ID NO: 728 - DNA, 661 bp, Homo sapiens
  misc_feature [331]..[331]: Chromosome 5, SNP identification no. = rs7712212
  misc_feature [331]..[331]: allele = a, in linkage disequilibrium with rs10491268, respectively
  misc_feature [331]..[331]: n is a, t, c or g
gatactgtccatcttcacaaagtttagaagtcctgtcttattcttgggtataaagcagcaaccctatatggactgctaagagagactgacacttagctcttgctcctccctcccctgccctctcctcctctcatctccacttctcttccattctctcttcttcattttccttcgtcctcttccttttcctttctctttccctccctgtctgtccatctgtcccttcctttctcaatctccaacccttcctgcctttcattatctaataaaaagccggattgttttttccttggcatcctactcatcttcatttccctacaccttgtcctcnctgcccctactgttccctgcagtctcgcagcatttgcaggaaataacacgtgtgtgtatgtgcatgtatgtgtgttctgtcatttctgtggtgacatcaaattacaaatgcttgccaaagcaaagccctgccttctttattcaaaatttgtaccaggtgacagaaaagtccatagtgattacctgggcatcctcacagttaccataacatcgaaaacttgatctttgttcaagtgaaataaaatctggagagcctggagagataaaagcaaaaagtcccttgggtctttgccaaaatgacactcttgtgcttttttcattactgattcac

SEQ ID NO: 729 - DNA, 661 bp, Homo sapiens
  misc_feature [331]..[331]: Chromosome 5, SNP identification no. = rs7712497
  misc_feature [331]..[331]: allele = a, in linkage disequilibrium with rs10491268, respectively
  misc_feature [331]..[331]: n is a, t, c or g
tttagaagtcctgtcttattcttgggtataaagcagcaaccctatatggactgctaagagagactgacacttagctcttgctcctccctcccctgccctctcctcctctcatctccacttctcttccattctctcttcttcattttccttcgtcctcttccttttcctttctctttccctccctgtctgtccatctgtcccttcctttctcaatctccaacccttcctgcctttcattatctaataaaaagccggattgttttttccttggcatcctactcatcttcatttccctacaccttgtcctccctgcccctactgttccctgcantctcgcagcatttgcaggaaataacacgtgtgtgtatgtgcatgtatgtgtgttctgtcatttctgtggtgacatcaaattacaaatgcttgccaaagcaaagccctgccttctttattcaaaatttgtaccaggtgacagaaaagtccatagtgattacctgggcatcctcacagttaccataacatcgaaaacttgatctttgttcaagtgaaataaaatctggagagcctggagagataaaagcaaaaagtcccttgggtctttgccaaaatgacactcttgtgcttttttcattactgattcacagctcacagtggacagttttct

SEQ ID NO: 730 - DNA, 661 bp, Homo sapiens
  misc_feature [331]..[331]: Chromosome 5, SNP identification no. = rs7716412
  misc_feature [331]..[331]: allele = t, in linkage disequilibrium with rs10491268, respectively
  misc_feature [331]..[331]: n is a, t, c or g
gcccctactgttccctgcagtctcgcagcatttgcaggaaataacacgtgtgtgtatgtgcatgtatgtgtgttctgtcatttctgtggtgacatcaaattacaaatgcttgccaaagcaaagccctgccttctttattcaaaatttgtaccaggtgacagaaaagtccatagtgattacctgggcatcctcacagttaccataacatcgaaaacttgatctttgttcaagtgaaataaaatctggagagcctggagagataaaagcaaaaagtcccttgggtctttgccaaaatgacactcttgtgcttttttcattactgattcacagntcacagtggacagttttcttagcatgttacacacatcattatataaatccaccagtaacattttaagttccataagcaaaattcttattatattattagctactgaggctcctctaggtgcccttagactgtttcctaactctgaaccctaggccattttccttatcatcgtttgttattgggaagtatgttagccatgcaagaagttaaaaaggtaatatgtacataccacctgtcaaaaaacatgacagatacagcctcttgccttactgtcaattaataaggctatggagacttttgtttacttatgtgtgtggctttttaaaaaac

SEQ ID NO: 731 - DNA, 661 bp, Homo sapiens
  misc_feature [331]..[331]: Chromosome 5, SNP identification no. = rs13362019
  misc_feature [331]..[331]: allele = a, in linkage disequilibrium with rs10491268, respectively
  misc_feature [331]..[331]: n is a, t, c or g
gcccttagactgtttcctaactctgaaccctaggccattttccttatcatcgtttgttattgggaagtatgttagccatgcaagaagttaaaaaggtaatatgtacataccacctgtcaaaaaacatgacagatacagcctcttgccttactgtcaattaataaggctatggagacttttgtttacttatgtgtgtggctttttaaaaaacttttaaccttcagtgatgtgttttaagtctatttctagaatagatagttcttcaatttagcttaatcacacgtatttgtttttttctactatcacattttgtgctttccacttatcttgntatttttatacttaacattttctccatttaaaatcttgttagaattgatcaatattttcttattctttactatgttttattgatttagaagctaaatattttagttttcttttttatatttgtttttaaattttcacttatgtataattgagaaagtcaaaagcaaatcaataactttatactttctgaacagtatcttagaacagtattttagctttgaagtttgtccacattaagttagttcctgaaccaatttatctgttagtcttatagtttttataataattacttgtatacataaaaccacaaatttatcaattcctttgctta

SEQ ID NO: 732 - DNA, 661 bp, Homo sapiens
  misc_feature [331]..[331]: Chromosome 5, SNP identification no. = rs9327496
  misc_feature [331]..[331]: allele = g, in linkage disequilibrium with rs10491268, respectively
  misc_feature [331]..[331]: n is a, t, c or g
tttcattaggatgaccattaccaaaaatcacaaataataaatgttggtaaagatgtgaggaaattggaatccttgggcattgctggtcggaatgtaaaatgctgtagccactacagaaaacagtatggaagttcctaaaaaattaaacatacatttactatatgatccagaaatttcacttctgggtatatgatatagtttcgatgtttgtctcctccaaatctcatgttgaaatgtaatcttccatgttgggggtggggcctggtgggagccattttggtcatgggggcagatccctcatgaatgacttcatggtggtaatgaatgaatncttgctttgtgagttcatgtgagatctggttgtttaaaagagcctgacacctcctccctcactctcttgttctcactcttgctgtgtgatacaccggcttccctctttgccttctgctatgactggaaacttcctgaggcctcaccaggagcagatgcagccactatgcttcttgtacagcctgaagaaccatgagccaaaattaacttctttctttacaaattatccagcctcaggttctttctttatagcaatgaaagaacacattatcacagtatatacccaaaagaattgaaaacagggatttgagtagatatttgttcacaaatg

SEQ ID NO: 733 - DNA, 661 bp, Homo sapiens
  misc_feature [331]..[331]: Chromosome 5, SNP identification no. = rs13358000
  misc_feature [331]..[331]: allele = c, in linkage disequilibrium with rs10491268, respectively
  misc_feature [331]..[331]: n is a, t, c or g
aaggcagccccatgttccctcaccctgtctctcttcttcgcatgtgattttttattctaacaattatcccattatctttactttttcattcacttcagtttgttgtaaaccattttaattgaccaggtcctatttgcctgatgaaaattcattatgtaatattttggcatctgcccttcctaataattgctgcaggaccttggcttcccaatttcaaacttctgaaaggaatttgatgtgctgatgattttgagtctaatcatctgggctagatatgttcattaactaaaaataaacgcataagaatatttcacttccctggcatcaatgngaaaactcagtgttcccacttcccagtgaaactggtggaaaaaaacttttttaaacctcaaccattttaattaagcttttagaaatgattccaagggcatttagcaaatgaagacacagttattcaagaaagcctactacaccctggtgaaagaaaacagtgagagtgtttcatttgaatgacaacctgcttcttccttcccaccatcccagcttgacatgatggaactgcactccagatggccactgccaagaacacagggctttctcttcccctacctcccaaacagaagtctatgctatcttccaaggaggggaagaatatcagcat

SEQ ID NO: 734 - DNA, 661 bp, Homo sapiens
  misc_feature [331]..[331]: Chromosome 5, SNP identification no. = rs4469239
  misc_feature [331]..[331]: allele = a, in linkage disequilibrium with rs10491268, respectively
  misc_feature [331]..[331]: n is a, t, c or g
agtgaaagttaagaagagttaagacagttaagagctgacttgaggttggaccaaatctgaaacacttacctcaaaaactatccctacaaagaaatttgaatttaattagaccatccgctgaacaatttatgccacagggcattgttgaaaacaatagagcaatcaattgtaattaatgggtcttaatagctggttgtggctagagaaagacacagtcaaagaaagccctgccaaaccactgtcatcccagagtgaccatgccttcccaaggctgctccctttaggagcaacagtagaggtttcactgtggcgatgcaggggatagacttcnctaaaggaatccagccaatcactaaacaaataggcaaacaacaatagcaaggcccagatacagtggtggggcggtgcatttgctataatgtattactgagatgtcttttttccagcaaaaattcccaagacataaccccacctcaaaaaaagagagaaaagtctgacctatacatggggaaaaaaatagcagacaacaagactgtctgtgagagcaaccagatgttggataaatatgttcaaaaaaccaaaggcaaccatgcttaaagatgtaaaggaagatacgttgacaaggtctcataatagagaataccagttatagaaattatga

SEQ ID NO: 735 - DNA, 661 bp, Homo sapiens
  misc_feature [331]..[331]: Chromosome 5, SNP identification no. = rs13360401
  misc_feature [331]..[331]: allele = a, in linkage disequilibrium with rs10491268, respectively
  misc_feature [331]..[331]: n is a, t, c or g
ccttgaggtagtcttctttaaattaaatctactcggtattctataactgtcttatacttggatattagtatctgtaggtttgggaagttctctgtttttaaccctttgaataaactttctacccatatctctttttccatttcctccctgagggcaataactcttagatttgccctttttgaggctattttctagatcctgcaggaatgattcattgtttttttattcatttttctcttgtctcctctgattgcatattttcaaagagcctatcttcaagctcactaattctaccttctgcttgaccaattctgctattaaaagactccantgtgttcttcagtatgtccattgtattttttcaacttcagaatttctgctttattctttgtaattatttcaacctctttgttaaatttattttactgagttctgaattctttctctatgttatcttgaatttctttgagtttcctcaacacagctattttgaattctctgtctgaaaggtcacatatctatgtttctccaggattggtccctgatgccttatgtagtttgtttagtgagatcatgttttcctggatggtgttgatgcttgtagatattcatcagtgtctagacatttaagagttaggtatttattgtagactttgcagtc

SEQ ID NO: 736 - DNA, 661 bp, Homo sapiens
  misc_feature [331]..[331]: Chromosome 5, SNP identification no. = rs6595867
  misc_feature [331]..[331]: allele = a, in linkage disequilibrium with rs10491268, respectively
  misc_feature [331]..[331]: n is a, t, c or g
tgacaatggccagtctaaatgctccctctgtgggcatgtatcagctatgtacagcccagttctgtttcccctatgacagagcagcactgagttcaatgtaaacagtctcacaattgctgtgctctccctctccaagtactcagattctctgtgccatgctgccgctgctggaggatggtgggagaggtagtattgctgattcaaggctgtctttcctgcccttttcagtgactctttcagtaatatgaagttaaaaccagggaccgtgagtaccacctgatttttgattcttatgaaggtgctttttgtgtgtagatagttgttacatttngtgttcctgttggggtacacccggtgcagctttctattttgtcaccttgctctgcccctttccatgtgttatcatttgtgcagagaaatattgagggttaaaaattgagaagaaattgtcatcttttgtcagaagcattagaattataatgtgaaaggctacatagactttggggcaaaactaagagatggtaaaggaaacgggaaaatgtatccatttgagagaaaaaacttagaaggccatttttgaaagcgaatagttaagagcttggattagaacgctcaattaaggcacattgtgaaaagggtataagatttaatgcattaaata

SEQ ID NO: 737 - DNA, 661 bp, Homo sapiens
  misc_feature [331]..[331]: Chromosome 5, SNP identification no. = rs6873372
  misc_feature [331]..[331]: allele = t, in linkage disequilibrium with rs10491268, respectively
  misc_feature [331]..[331]: n is a, t, c or g
tccctctgtgggcatgtatcagctatgtacagcccagttctgtttcccctatgacagagcagcactgagttcaatgtaaacagtctcacaattgctgtgctctccctctccaagtactcagattctctgtgccatgctgccgctgctggaggatggtgggagaggtagtattgctgattcaaggctgtctttcctgcccttttcagtgactctttcagtaatatgaagttaaaaccagggaccgtgagtaccacctgatttttgattcttatgaaggtgctttttgtgtgtagatagttgttacatttggtgttcctgttggggtacaccnggtgcagctttctattttgtcaccttgctctgcccctttccatgtgttatcatttgtgcagagaaatattgagggttaaaaattgagaagaaattgtcatcttttgtcagaagcattagaattataatgtgaaaggctacatagactttggggcaaaactaagagatggtaaaggaaacgggaaaatgtatccatttgagagaaaaaacttagaaggccatttttgaaagcgaatagttaagagcttggattagaacgctcaattaaggcacattgtgaaaagggtataagatttaatgcattaaatacataaaactagtaaggattgca

SEQ ID NO: 738 - DNA, 661 bp, Homo sapiens
  misc_feature [331]..[331]: Chromosome 5, SNP identification no. = rs6880855
  misc_feature [331]..[331]: allele = c, in linkage disequilibrium with rs10491268, respectively
  misc_feature [331]..[331]: n is a, t, c or g
ttacgtcaattcttcaaacatttttggtgctcaatttgtggaacactttaaatgtttccaatttattttaaagaaaatttcttctaaactttaaagaattaacttacagaaatattcaatgacatcatagaaatttaaggttgatttacaaggtagttcttccaaggctcaaatatatctaatctacaattaatattcaattaataaagtatctgcagcaaggctgaaatgatttgtaaaatattaagcattagattacttgcaaagatttttagattagtttatccaattatatgtgtaataatatttgtaatttgtaaatttggacaantaacatattccatttcagtcagtagaattgtgaaacttgtttgaacttggttttgaattatgtgttcatcatgaccaattccagctgaattgtccttttatttttaagattattattttatcatgaagctgtgtttattctaaatttctcttcatatttttattaccaaatcatatttttatttttaaatttttcaacgaattttacaatagcatctacattgtcagctgttttacttttgcgaagtgaactaaaaacttctctttgattccaataattagatgaaaaatatttgaatgattattgatatgagtttaactgatttctatt

SEQ ID NO: 739 - DNA, 661 bp, Homo sapiens
  misc_feature [331]..[331]: Chromosome 5, SNP identification no. = rs1421889
  misc_feature [331]..[331]: allele = c, in linkage disequilibrium with rs10491268, respectively
  misc_feature [331]..[331]: n is a, t, c or g
cctcgaaaccaagtataaaaatgagatatcgttaatcatgtcacggtcacaaaacgtgtatctactacgattagtgataaacatcgatataattatcgattgtcgataactaattatccattttataaatataacgctactttgagtggtaaatattaatcacaacggtagaaactcattcctatttgttaactatgataaaccaaattgtcattcacttgccgacacgtgggtataagactacaattggactcggagaacactgttatacaccaaaaaattttctaccgacgtttaagaaactgtgaagagggtaacttcgactcgtgtnacagggaaggggaacttagacccggtcagaaactgacgacactagttccttataatgtctgcgctgtgactcgatcaagatccagatcggatttttcctaactgtgtaaagtgaaatcagagaccctcgggacccggtcccgtcattctttagactgattggactccttctcttacacacctcttcgggtctccgatgcaacctccccctccttctttccatcggggtcctttgtccttattctcacttaggtacacctgggaggtttggtctcaccgacggttgacttatgatggtgcactggtgtcacctacggtgtacgtcaccttt

SEQ ID NO: 740 - DNA, 661 bp, Homo sapiens
  misc_feature [331]..[331]: Chromosome 5, SNP identification no. = rs9285913
  misc_feature [331]..[331]: allele = g, in linkage disequilibrium with rs10491268, respectively
  misc_feature [331]..[331]: n is a, t, c or g
atatccttcctcacaaatgttatttgacctctctttcgatttagactcacaagagaaataatctcaaattgctgttccctctataaagttcttcccctagatttcacattgctttttcaagtttcataggtatctgctcaattcatttctatgaagacctccatgattgccctgtaaaaaaaaaaaaaaagacatcataacaccatttgtacctctagtattcctctccctccctgattctaatttattattgtcaaccaatctaccatacctttacttatttatttgtttattgttctcccctagtaatatgtaagctttgcaagagaanggattttgtcaggcttgttcatggttgtatccccaacttccagaatagtgcctgcacttggtgggtattcactaaacatgtgttgaaagtatgtattgccataaaggttggaacaattgaaataattgtagcaagatggtaggtgtatttaaacagaacaagtgtcataaataaaagagctctaacctaaggatggagaggtagaagttctcattcctgttctacgcgactactaaggaccctcatgctgccattcaaacttcgtggtatttgggttctatttagtcaatatggataataatatcacttttactcatatcctgacataga

SEQ ID NO: 741 - DNA, 661 bp, Homo sapiens
  misc_feature [331]..[331]: Chromosome 5, SNP identification no. = rs10478827
  misc_feature [331]..[331]: allele = c, in linkage disequilibrium with rs10491268, respectively
  misc_feature [331]..[331]: n is a, t, c or g
gtctttgtcctagctgtcaataggcctctctgagcacattttctcccattcttttgcttgcttctctttttgcacttgtttctcttaaaagttggtgtctcccagggttctagcttccagtcttaacccacttcttttgttccatacaccctccccaccccaaacccaggataatcttgtggtcttcacccataatatatgtattagtgactcccaattcattctcacagtcctggccattctttctggttccctgtagatagacctcctttgctggttactcttcttttctctgactgttcaatattggagaaccacagggcttagtcantggactttctttccagttatattccctcccttggttatctaattagtctaatggctttaaaccatgtgatgatttccaaattcatatctccagtcaagactttctccctccactctagacctcaatgccccctcaatattgctatttgaaggtctcataggcttctcaaatttaacattgctaaaactgaactcctggaaattctgtctttctgatgattcaggtcaaagacttggggttgcctatggctgcttctttctctaacatcttaagttctctgtcttcttttctttctttctttttttttctttaaagacaaggtctcactct

SEQ ID NO: 742 - DNA, 661 bp, Homo sapiens
  misc_feature [331]..[331]: Chromosome 5, SNP identification no. = rs9327500
  misc_feature [331]..[331]: allele = g, in linkage disequilibrium with rs10491268, respectively
  misc_feature [331]..[331]: n is a, t, c or g
gagaggaataaaaattacttatatatcatattcattcatcattatatcatttcagtgaggctacacagggattggcttttttgcaggtaatatattttaagtctttaataattagaataaaaagaatatcactaggagtaaagatatttaaatatattatatattgtgtgttggtgcttaatattaatgcttatatgcatatatgtatatttatatgtacatagatacatacatatatatacttgcaaaaaatattttaagtggctttaacaaattaaattgtagcatgaaaaatatgcagcatggtaaaatacaaagaatatgctataantaagtgcaaaagggccaaataacattgtctgaattattgcaccagcctcctaacctacatcttttcttctagtctctaaatttggaattaattctccacatatcttctagagtaaattaatgtaatcattttacttctctacttaaaccacttcaatgaattttgcttttctattaacttctaaagatattaaaaattattagggggatgcttttgctctcttaatagagcacttctgatagtgaaaaaggttgacactcctctacttccctcatctgctaaagataatcacaaaccaaacattagaactccccatgtacaatagcactc

SEQ ID NO: 743 - DNA, 661 bp, Homo sapiens
  misc_feature [331]..[331]: Chromosome 5, SNP identification no. = rs13436689
  misc_feature [331]..[331]: allele = g, in linkage disequilibrium with rs10491268, respectively
  misc_feature [331]..[331]: n is a, t, c or g
ccagcttttcttttaaacaagttaatcttgtttgtatatacctatgtgctacatattaaaatgtaaaaatttattaatttccagcaagtaaaaacaaacataatctcaaccaaattttgttttagcccagtgttactcaaataaaggggtgaaataagagtgcttttaagttattttgaaaaacacacacacatatatcccaataaagctgtaatgcggatatctaagcttaccaataccagcaaaagtcaggaaaagagccagggacttctacatagggaaaaacaaagattaagagacaagtcttatcaggtaatgaggaaaattgccnaaagacaaaaagggagaaaataaataggataggttccattgaaaagaaccctgtgagtccttaaaaaactggaattacagtttgaaaactacatcttaaaacacatggggccaggtgcggtggctcacacctgtaatctcagcactttgggaggccgaggcaggcagatcacctgaggtcaggagtttgagactagcctgaccaaaatggtgaaaccctgcctctactaaaaatacaaaaattagtcgggcgtgattgcaggcgcctgtaatcccagctactcgggaggttgagcaggagaatcgcttgaacctgggaggcggaggttgc

SEQ ID NO: 744 - DNA, 661 bp, Homo sapiens
  misc_feature [331]..[331]: Chromosome 5, SNP identification no. = rs13156417
  misc_feature [331]..[331]: allele = a, in linkage disequilibrium with rs10491268, respectively
  misc_feature [331]..[331]: n is a, t, c or g
tgcttgattgcagctgatcacaaagagaaagataactgaaatgcaaaagaatttaattacacaatttgattgtatcaaaaaacaaccatttggctgggatctcagatctctggtatatggaaacataatggtttaatcttaggcttaagcacaatttgttaacgaaattttcaaagacagaatgacactgttatttctgtaagttatttctgaacatttctccagtgattgagactcatctacatacttctgcaaaaaatacattagctgaatgtatcccccacttggtctcggaagtacagaaacttatcttgggccttcaagaacaggnatccagaattctaacaccgatctcctttcacaaaagcattgtttaggagtttgcttttagcagccttttcatttccaagaatagattgcttgtaatagtttagaaataggttgcttgtaatcacttgggatgtaaaaaggcaaaaaattttacccctgagggatacaaagggaagaaacatgataattgtcctcattatttattccatgacctagacacttacatacatactgacacttcggagatttatttttttcattattcttaaaggaatcatcatcagtgtttactgatagacaatattcctcgtttaaattgtgctaaaatgta

SEQ ID NO: 745 - DNA, 661 bp, Homo sapiens
  misc_feature [331]..[331]: Chromosome 5, SNP identification no. = rs10477690
  misc_feature [331]..[331]: allele = c, in linkage disequilibrium with rs10491268, respectively
  misc_feature [331]..[331]: n is a, t, c or g
ttataataatttcttttgtaagaaaagttatactattatgtcctgttttgttgggtagtggtgaaaagattgtggtcagagctagaatgtcccatcttaggagaaacttccataaccacccatagaaagtagctacccaatccctctttaacatgacttaattttaatattctacataaaaccaatccaaattttatttttttaaaaagtatttatgtactttattgtcttaacactgaaaagtaatgtatacaagcaaagaattgcccttgttattcacagctgtatctttaggaccaacagtggtgccaggcagagttggccacctaanaggtattcgtcactaataagacatttatcataaaactatgggagattcaaagatataaatatttaacacagtgaccatttcttggtactggtactttttattaatgtatttattaaaattgataagtaaaaattgaacttatttatggcatataagatgatgttttgaaatatgtatacattgtggaatgactaagtcaagcaaacatatgcgttaccacacatacttatttctttgtgatgagaacacataaaatctcttctcttagtgattttcaaatatacaatacattgtattaactgtagtcatcgtattgtattataggtactg

SEQ ID NO: 746 - DNA, 661 bp, Homo sapiens
  misc_feature [331]..[331]: Chromosome 5, SNP identification no. = rs6867677
  misc_feature [331]..[331]: allele = c, in linkage disequilibrium with rs10491268, respectively
  misc_feature [331]..[331]: n is a, t, c or g
aaaaactgcaattagaagcacacaaaatattctgtagaattcaaagaaaggagagatcatatcacattagaagttaaaagaaagatttcatggaatagttgacatatcattcaggcagtgtggcagaaacttctagttgcccacctgaatatccatttaccctttcctttttaggaacagaattctgatttttagctgagctcattgatgcgtgaatagaaagactgcatttcacaggctcccttaaagctgagtgcaatcatgtgactaagcactggccaaagaaatgtcaacggaagtgttatgtgtgatttctgtcaatgtcacttanaagtagctgacttgcagagagaaaggagataaatcttttttttttttttttcatcactattctgccttttgtctgtcttttggcccacaccctcagatataatggctggagtttcacagactatcctgggtcatgaggtgactcgaagacggaaaacttgccctagtctgatagagcagaaagacagaaattgtgttcttatgaaaacatggaatgaactttctacctccagacttattttacacaataatgaaataaacttctaacttatgtaagcccctattattcagagatattctggtccatcccactaaaacagattctaatcta

SEQ ID NO: 747 - DNA, 661 bp, Homo sapiens
  misc_feature [331]..[331]: Chromosome 5, SNP identification no. = rs6861915
  misc_feature [331]..[331]: allele = t, in linkage disequilibrium with rs10491268, respectively
  misc_feature [331]..[331]: n is a, t, c or g
attaccttcaagcctgttgctttaaataaatcagaaatcatagtaaagaagtaatttgtccatttcaacccctttgttctatcttctaaaacctattgagctcatctaataatcctcaaatgcattattaaataattaagaagttttgaggaaaaaaaatccttgtgaagacttgtcaatccctttcttatcctacctccacaatgagtctacataatctgtaagcttatcccacccttctcctaattcaacatgagaaaatatgcgaagcatcatgcctctgatgaaaaatgggatatttggaaagtttctattttgctaaatgagttcnctaccttctacatcttctgctccaccatctacccttgtctctgcgctgtccctcctgctctatatagacacatgcacacgtatgtttattgcggcactattcacaatagcaaagacttggaaccaacccaaatgtcaaacaatgatagactgggttaagaaaatggcacatacacaccatggaatactatgcagccataaaaaatgatgagttcatgtcctttgtagggacatggatgaagctggaaaccatcattctcagcaaaatatcgcaaggacaaaaaaccaaacaccgcatattctcactcataggtgggaattgaacaatgag

SEQ ID NO: 748 - DNA, 661 bp, Homo sapiens
  SLC27A6
  misc_feature [331]..[331]: Chromosome 5, SNP identification no. = rs10042256
  misc_feature [331]..[331]: allele = a, in linkage disequilibrium with rs10491268, respectively
  misc_feature [331]..[331]: n is a, t, c or g
tgcctttggtagcatttgaaagtgaatgcaaaatttctggacaaaatagaaacaggtacatgggctaatataggaatatacacaatactgttaactgtcccaagatttttcattgattatgtcttccatggtgagatttcaggcataaaattggtttgggttagtacaaagtctggcccaacatatgcttacttgtagttcttcctaataagtcaaacaagctcacatttatggtgctgaatatattctagattcattgtatctgtagttgctaaaaatttagttccatgccttaggatggtattagaatgtccatgataagaaaaataantgcagcaaaataaaagaaatgccacgcctatctttctgtattattttttccactggagaaggacagattttactcattaaaactacaaaagtctgagaccaactgctccatattcttttgtgttcgttaaatgttgttatttggaggtgacttaattagactaaagctagaagagaaaacaatagaatgtcaaagatgcttttcaagttgtaaactaatgttttaagttataaactacttgatactattttcttaattaaaaagatatttctgaatcgaaaagatcaaagcttctgagtaaatttagaaagcatttttttgtcatttaca

SEQ ID NO: 749 - DNA, 661 bp, Homo sapiens
  SLC27A6
  misc_feature [331]..[331]: Chromosome 5, SNP identification no. = rs11740497
  misc_feature [331]..[331]: allele = a, in linkage disequilibrium with rs10491268, respectively
  misc_feature [331]..[331]: n is a, t, c or g
ttaaaaaacaattgcctttatggttgaaagtcatttggagaattacaatggcttgattgttaacaagaacatttgttaacaataactacaaactatgcaccatttcagtgtaacagtttactaacagtgcaaggctgcatgcattattttgtgtttatagagaagacacaggatttttacttcttacgaagagaaatctgaaatgcttcaaaatatgttgaacagcaaaatactatcaaatctaaattgaaagagttccgggtaattgaatagttttttaaaggtctctatttataagtataatgatttaatatgtggtgtattaagaaangatggagaataaaatatataccatatgcaagtaaatctgaagccttgtgggtgcctactatgtctaaagtgctttgtaccttttgggagtgatgattagtaacattgacatcaacacaaccaggaaatcccaaccatatcaccaccctcaaaaccagttaccaaatgaacagtggagagtggacaactttttgcaaaaatatgcgaagtaaattaaaagttagcaagtgttcatgtgtatcatagtttttattatgccattcattcactcattcatccagataataaatacttgttgaatatctcctttgtgctaagtcctgaaaattta

SEQ ID NO: 750 - DNA, 661 bp, Homo sapiens
  SLC27A6
  misc_feature [331]..[331]: Chromosome 5, SNP identification no. = rs10038006
  misc_feature [331]..[331]: allele = a, in linkage disequilibrium with rs10491268, respectively
  misc_feature [331]..[331]: n is a, t, c or g
tagttcccatgccaccttgcctagatgtatgagcttgagtagagtatttgcccactataaccaggcttccctcgtccttaaaataaggttaatatttacctatcatggctgtaagtgttgatcaccaaaaataatgtataaaaacattttgtaatctatgaagtactttaaaatggcaagtattcttatttatcatcagcagcattataattatgactaaacatgccaaaggatatagagataatagcatacaaattttaaatgatataaaagcaccccaacattgttctgtttgttttaagtaaagagaagagcatagatcagtagatgntaatcttggcagcagataatattagcaatatcagagatgaaaaattgggggaaaggttgaggtttaatctcaaacactttaattttcaataagtttcccagagaaatttgggatgccatttgatatatgttctaatccaaaaatacacagatataagacttctgcaagtatttttgagtcttcagactgtgtgggaaggaaataatagtattataaaaattttaacatttttcttatctgtgtataaaaaacttggtgtcttaatattggtaacttttattttcatattttgtatagcctgaatgtgtattttttcagttacatcaaagt

SEQ ID NO: 751 - DNA, 661 bp, Homo sapiens
  SLC27A6
  misc_feature [331]..[331]: Chromosome 5, SNP identification no. = rs17617241
  misc_feature [331]..[331]: allele = g, in linkage disequilibrium with rs10491268, respectively
  misc_feature [331]..[331]: n is a, t, c or g
ccaaggtgggtggatcacctgaggtcaggagctcgagaccagcctggccaacatggtaaaaaccccgtctctactaaaaatacaaaaattagttaggtgtggtggtgggcatctgtaatcccagctacttgggaggctgaggtaggagaatcacttgaacctgggtggcggaggttgtagtgagccgagtttgggccactgcactctagcttggaggacagagtgagactccatctcaaaaaaaaaaaagaaaaaaaaatccagttgtctcattttcctgcagtagtttacgatcaaaatggtacaaatttcagtttctgtaaccagttanctatctagcacctaatggcatgcggccaggtagagtgagcagaaggatggaggagaacacacatcattcttttgagatgcttataattctacaggtatcaatggtaatgcagtgaagcataaatcctcatgagataaagtcatttccttaaagtatttaaacaaatgctattttgtgtcaagacaatattcagaatttactgttaaaggacatgaaaagagtttttttctttcttttcttttctttttttttttgttaagatggagtctcactctgtcccctaagctggagtgcagtggcgtgatcttggctcactgcaacctccgcctc

SEQ ID NO: 752 - DNA, 661 bp, Homo sapiens
  SLC27A6
  misc_feature [331]..[331]: Chromosome 5, SNP identification no. = rs10065480
  misc_feature [331]..[331]: allele = c, in linkage disequilibrium with rs10491268, respectively
  misc_feature [331]..[331]: n is a, t, c or g
cttattcatattttaactttcttggcacttatttccccaatttagacatacatatcattaagaacatataaaagtttgtgctgggaatttcttattctagatgagagattttgaaattaaagtaatgagtcagttcagagatttgcacttacaagttcaaaacctgagaaagagtcattacaacaaaatctggaacaaacattaaaaagaaagtctagatcctttgcttatccagtttttcatgtttctaacttgtcactcctcctatcatccttggtgatttttcacattttgccaaagcaatctatatacagcagcatgatgtgtgtgngttaagtagagctaggcattttccctggattcttatattttacttagatttgttatagaaataaaaattaataagacatcttaaggctatgaaccccactttccaccgcatatcaacttcattataatttctgtgttgccttctattttcatacaggttttatttataaactgcttagtcccacttgacatatttatcttgctgctgctttgtgatcaatctgggttatagatttcatgaaagtaaatcaagagttttcccccaatgtatttcattgtagtagaactaacccaatgactgatagttggccttttgagggaaccagatact

SEQ ID NO: 753 - DNA, 661 bp, Homo sapiens
  SLC27A6
  misc_feature [331]..[331]: Chromosome 5, SNP identification no. = rs11743701
  misc_feature [331]..[331]: allele = c, in linkage disequilibrium with rs10491268, respectively
  misc_feature [331]..[331]: n is a, t, c or g
tccctgtttcaatacacaaaagcaactccaaagtgaattgtttgagatttaaggtttgcttaactcttcccaaccctttggcttttagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtatgatccaattcttttgaaggctaaaatgaatgcganaaatttgcaaagcaacagtgttgggcaaatttctaccatgtgtagtgaccaaccatctgagaatgcatgcttgcaagaagatgtaaggatctcagaggctagaactttccaacttggatggaaagttaattatcttaacttttacttgaaaagtcattgtgttcatttggcatttgtctcatttgacaagattttcttaaagtttggtagtacaaagggcatgggagtatccaaacaccttgatccagtctcattgctcagtgtatgatacttgatacttgattttttgggcaagatctttgttagcttctctgatcctcaaatttctga

SEQ ID NO: 754 - DNA, 661 bp, Homo sapiens
  SLC27A6
  misc_feature [331]..[331]: Chromosome 5, SNP identification no. = rs3886286
  misc_feature [331]..[331]: allele = t, in linkage disequilibrium with rs10491268, respectively
  misc_feature [331]..[331]: n is a, t, c or g
tcgatagactatttctcgtaaaccctccattcaaaaacagtcaggaatacacggacttttacagaaaaaaacggtggatatgtgaacttaccgacgaacatttcttaagatccattcatcagtaaaaatgcgtcctgaaacttccgtaacgagatattagaagactgaaggtcatatatataactcgttaatagtcagaaagactaaagaataggaaacctacgttgtaccataaagataaaaaaaagtaaaaaccttagaagataaacaaaagtcatcagacattatagtactactgaaaatgaccctggtcagagtagataggtaaagngaccctttaaaaatccgaaaaagtcagattgttgagtccagaatatcaagatctataaaaacttaaacttttgttttattaaaagtgtggggtaagaagagaaaggaaggaataaagacaagaaaaacgggtaacgaaaaaagacaatgtaaataaacacacaagtaggaaagtaaaaatcttgagaactaaaagacttctagtcgggaggacctgtcttagtgaccaaaggattacaacggataggacaaaaggaagagaatggaaaacgaaatgaaaaactctctaaaaggttgttaatacaagagacttataaggagaaaaacatca

SEQ ID NO: 755 - DNA, 661 bp, Homo sapiens
  SLC27A6
  misc_feature [331]..[331]: Chromosome 5, SNP identification no. = rs7735034
  misc_feature [331]..[331]: allele = g, in linkage disequilibrium with rs10491268, respectively
  misc_feature [331]..[331]: n is a, t, c or g
tgggcttttggttgtactgctcatgacattgtttatataacccttcctctgtatcatagttcagcagctatcctgggaatttctggatgtgttgagttgggtaaggctttattttctttttgataagttttcaaaatgtctaataattagaacaagtatttattaacatttgaagctgtatcggtagaatttagagtgattatatgcatattattttattataacacaatatttattttaaaaaaactacacaattttatggcatattcagtgttttcctgaggtgaaaagaacagttttctgaggatttggccatgtggtcggagctggntattggctgggcttctctctccttgtagtcactcaccctcaaacaaactaccccagattcctcaaatgtagtagaaatgttccaagggagtgagtatggaagctgcataaatcttaaggcctagtcttgaaagacacataggttattttaccttcattccattgatcaaagtaagtcatgggccagcctagattcaagattccagggctggagaaacagaagccacctcttgaagggagaaggagcaaatttacactgcaaaagtaagagccctgaagaaattgctgaggccatctttgcgaacagtctgccatagacactcaataaatt

SEQ ID NO: 756 - DNA, 661 bp, Homo sapiens
  SLC27A6
  misc_feature [331]..[331]: Chromosome 5, SNP identification no. = rs7730969
  misc_feature [331]..[331]: allele = g, in linkage disequilibrium with rs10491268, respectively
  misc_feature [331]..[331]: n is a, t, c or g
ttctctctccttgtagtcactcaccctcaaacaaactaccccagattcctcaaatgtagtagaaatgttccaagggagtgagtatggaagctgcataaatcttaaggcctagtcttgaaagacacataggttattttaccttcattccattgatcaaagtaagtcatgggccagcctagattcaagattccagggctggagaaacagaagccacctcttgaagggagaaggagcaaatttacactgcaaaagtaagagccctgaagaaattgctgaggccatctttgcgaacagtctgccatagacactcaataaattagttggtagagcntgtgactcagtagattccattcataaacatgcaagattatgtgtcagtttctagacctcacataatatacaaacagtggagatcatttgctacttgtatttgtctaaaatgctgtaatttttagaatagaatatttagaatatgatcaatatccaccataaatgaagatgagatattaaaagacattaaaatcttcagtggacatacattgttgtcaaaattaggttctgcagtcatttaagaacttttttgttagtactatcttgctaattcaaccttactaacagttgacctcaagatatgttgaggtggccgggcgcagtggctcat

SEQ ID NO: 757 - DNA, 661 bp, Homo sapiens
  SLC27A6
  misc_feature [331]..[331]: Chromosome 5, SNP identification no. = rs11749027
  misc_feature [331]..[331]: allele = c, in linkage disequilibrium with rs10491268, respectively
  misc_feature [331]..[331]: n is a, t, c or g
aagattccagggctggagaaacagaagccacctcttgaagggagaaggagcaaatttacactgcaaaagtaagagccctgaagaaattgctgaggccatctttgcgaacagtctgccatagacactcaataaattagttggtagagcttgtgactcagtagattccattcataaacatgcaagattatgtgtcagtttctagacctcacataatatacaaacagtggagatcatttgctacttgtatttgtctaaaatgctgtaatttttagaatagaatatttagaatatgatcaatatccaccataaatgaagatgagatattaaaagncattaaaatcttcagtggacatacattgttgtcaaaattaggttctgcagtcatttaagaacttttttgttagtactatcttgctaattcaaccttactaacagttgacctcaagatatgttgaggtggccgggcgcagtggctcatgcctgtaatcccagcactttgggaggctgaggcaggtggatcacgaggtcaggagattgagaccatcctggctaacacggtgaaaccctgtctctactaaaaatacaaaaaattagccaggtgtggtggcaggcacctgtagtcccagctactcgggaggctgaggcaggagaatagtatgaa

SEQ ID NO: 758 - DNA, 661 bp, Homo sapiens
  SLC27A6
  misc_feature [331]..[331]: Chromosome 5, SNP identification no. = rs17679250
  misc_feature [331]..[331]: allele = g, in linkage disequilibrium with rs10491268, respectively
  misc_feature [331]..[331]: n is a, t, c or g
caggataggactgacccaaagactgtgtttagactaaaattaaaatttctataaacataacacgcatcagattatgaaattagattcatgctatgtttacagaaagcaattattctaaggttaaaataatcttttaaaatgctgttctttaaaaaaataactactgaccactgacactgattataatttattttctattttttcttttgaataagtgattatattaggatatctttttgttttactttaaattaaaaaaaaaaacccacattgctttgatttgcacttgtctccttaactgaagaagtcatttccacattcgtttgatcanctgccaccatctgaaaaacagataagcagagacagttgcaatagcctgaagtttatctttattggttcatttgtttttttgccctcagaagttattttctttttcctgctttcgtttatctctccaaatgcttcttctttaactttatgattttctaaacattcttgagactataaagaagttactttctttaatcaaatttatttaattctttatattattttattattataaattatttatcttttattatctgattattttaaacatcagatccacatcagccccttcaagaatgacaatagagtaggatattgccctacgtggggt

SEQ ID NO: 759 - DNA, 661 bp, Homo sapiens
  SLC27A6
  misc_feature [331]..[331]: Chromosome 5, SNP identification no. = rs17617329
  misc_feature [331]..[331]: allele = c, in linkage disequilibrium with rs10491268, respectively
  misc_feature [331]..[331]: n is a, t, c or g
atgtttacagaaagcaattattctaaggttaaaataatcttttaaaatgctgttctttaaaaaaataactactgaccactgacactgattataatttattttctattttttcttttgaataagtgattatattaggatatctttttgttttactttaaattaaaaaaaaaaacccacattgctttgatttgcacttgtctccttaactgaagaagtcatttccacattcgtttgatcaactgccaccatctgaaaaacagataagcagagacagttgcaatagcctgaagtttatctttattggttcatttgtttttttgccctcagaagntattttctttttcctgctttcgtttatctctccaaatgcttcttctttaactttatgattttctaaacattcttgagactataaagaagttactttctttaatcaaatttatttaattctttatattattttattattataaattatttatcttttattatctgattattttaaacatcagatccacatcagccccttcaagaatgacaatagagtaggatattgccctacgtggggtggggcaacagaaccttggcctttgagacccacctttccttgactagaggatctctcaatagagtaggatattgccctacgtggggtggggca

SEQ ID NO: 760 - DNA, 661 bp, Homo sapiens
  SLC27A6
  misc_feature [331]..[331]: Chromosome 5, SNP identification no. = rs3851463
  misc_feature [331]..[331]: allele = c, in linkage disequilibrium with rs10491268, respectively
  misc_feature [331]..[331]: n is a, t, c or g
atttcagtactttagagttgacttccactggaattagaatgacctcccgtaattaagggatttaattggatcaggtctatagtgtaatggtttttcatgttacttttgatcttctattttatacactccaacaccgtaagattcacataataaccccaagaaatctaattctgatggagggaatggactccgttccagaggaacttctctttttataaattttttacattttgtaaatagaccttgagaaacagaaccgatacttagacaccttagatatcaataaacttcgtgaggtccgttttttactcattcctaccgaagacggtgnccctccacccagtcttcgagctgacctccaaagaggaaccacttgaggttcgagttttactttttcagaataaatttacggaggtcggatcacagtcgacacgagacccattaattaactttttaatgtaccggtctaaaatcggtttctcttctcttctatagggtcgtgtggtaagtacggaattcgtctacactactaccgtctccactattcactctctaggagatcagttcctttccacccagagtttccggttccaagacaacggggtggggtgcatcccgttataggatgagataactctctaggagatcagttcctttccac

SEQ ID NO: 761 - DNA, 661 bp, Homo sapiens
  SLC27A6
  misc_feature [331]..[331]: Chromosome 5, SNP identification no. = rs6859805
  misc_feature [331]..[331]: allele = t, in linkage disequilibrium with rs10491268, respectively
  misc_feature [331]..[331]: n is a, t, c or g
ccatctctcaaacatgcaccctattccccactgcttctctttttcaaaactccagttacaaaagttcttttggcataaacgttagatgtacttctttaaaactgctggcagcagcattgttttcagaaaaagagactgactcctgttagtcatggtgagatgaagttgttcttctcttcccctgagactaggaaagcagctctccctcacttttaatcttccaagttttctatgtcactaaagcaccatcatacaatctgattgggtctagttctatattttcttaatactaatgttgtctttaatattgattggtgaggaatatgttggnactctagacatcagtgatcctctaggggagtcttgctgcagagtttgtcttatataagcaattccacctaacacagtcaacagttagccatatctagggatatatctagggatagaccatatatgtaacatattcatttcctcattcattcattcattcaagtaatattgtaggattagatatacaggacacacaggacaaatcagactgcttctctcttagaatttatactctctttgatgagggggagagaaaataaacccagcaaacacagatgaaaagtaattacagacaatgacaaaggttatgaagaaacaaaacagggtgcgg

SEQ ID NO: 762 - DNA, 661 bp, Homo sapiens
  LOC285768
  misc_feature [331]..[331]: Chromosome 6, SNP identification no. = rs9405439
  misc_feature [331]..[331]: allele = t, in linkage disequilibrium with rs9328033, respectively
  misc_feature [331]..[331]: n is a, t, c or g
tctggtacactgggacatggtaattgctcaagggtttaactctttttcttaatgtgaagtaccagtacgaaccagttttgaggtgtttgcattaaaactgctctgccatttgaaaaatctgatcaagagatcccagctgctcagctggtggaaagaaccccgagttcatgaaattattagggtaatctaaatgaagcttaatagcacttagcacttcaaagcacactgagcacattaactaattaatcgcagccttaccccttcaaggtacataaatggctattatcctcactttacagttgggataaatgagacctaggtaagcaggagnagttgccctgggtcccgaatgaagtcaatagctccagtaaaggcaaaatcggacatttcggagtcgcccgtcttggctgcctatctgctcttcttcccacattttctttccttctagagcttggctgaaaagcttcacatttggatttggagagatttcaaatctttttcctacatatgactgtttatgacatagatactttaaaaccaagggagtccaaactgattaaagttataacaaattggaatgctggaaagtgcatgtcatcagccaaggaaagaggttagtctgattaaataatcagtttcatctgggtctgtttatgccatc

SEQ ID NO: 763 - DNA, 661 bp, Homo sapiens
  LOC285768
  misc_feature [331]..[331]: Chromosome 6, SNP identification no. = rs9391899
  misc_feature [331]..[331]: allele = g, in linkage disequilibrium with rs9328033, respectively
  misc_feature [331]..[331]: n is a, t, c or g
ttgcctgtgtgcatttcatactcccctgcaaagcagctcctcgcttcacaggaagaggcggaacttaaatccaaatacagttacagtgtttatatcctgggctgcactagttaaaaagaacctaagatttatggctcttttagatcacagaaccaaatcccaatacctcctgtcagatcttctctccttccagaagcaagtatttggggattataaaaagtgatgttatggatgatgtctcttaaaatatcagatcgacttgatggcaggacctgctgttcaaatttctttagagacacctcctcgctgccccgcccttgcctctctcccnacgagtgccagcccatgcgcacacacgcacaggtgtgtgcccaaccatgtgacttccctgctacctccagactaagcgggcatttcctttacatgtgctgttttctctgctattgtctccttccatcatccttttattttaacatatgtttactaaatgccattgttctagaaacattgaggcatataaaagtgaataaaaccagcaaataaattcccatcctcggccaagcgcggtggctcatgcctgtaatcccagcactttgggaagccgaggcaggcggaccacctgagatagggagctcacgaccaacctggctaacatggcaaa

SEQ ID NO: 764 - DNA, 661 bp, Homo sapiens
  LOC285768
  misc_feature [331]..[331]: Chromosome 6, SNP identification no. = rs9328033
  misc_feature [331]..[331]: allele = a, g
  misc_feature [331]..[331]: n is a, t, c or g
acagtgtttatatcctgggctgcactagttaaaaagaacctaagatttatggctcttttagatcacagaaccaaatcccaatacctcctgtcagatcttctctccttccagaagcaagtatttggggattataaaaagtgatgttatggatgatgtctcttaaaatatcagatcgacttgatggcaggacctgctgttcaaatttctttagagacacctcctcgctgccccgcccttgcctctctcccgacgagtgccagcccatgcgcacacacgcacaggtgtgtgcccaaccatgtgacttccctgctacctccagactaagcgggcntttcctttacatgtgctgttttctctgctattgtctccttccatcatccttttattttaacatatgtttactaaatgccattgttctagaaacattgaggcatataaaagtgaataaaaccagcaaataaattcccatcctcggccaagcgcggtggctcatgcctgtaatcccagcactttgggaagccgaggcaggcggaccacctgagatagggagctcacgaccaacctggctaacatggcaaaaccccgtttctactaaaaataccaaaaattagccgtgtgtggtggtgggcacctgtaatcccagttactcaggaggctgaga

SEQ ID NO: 765 - DNA, 661 bp, Homo sapiens
  LOC285768
  misc_feature [331]..[331]: Chromosome 6, SNP identification no. = rs7756730
  misc_feature [331]..[331]: allele = t, in linkage disequilibrium with rs9328033, respectively
  misc_feature [331]..[331]: n is a, t, c or g
aagaagttgagtctcacaaaaattaataaagccccaaaagtgattcaaagctacattccaaagtctttgctcctttcctgccaaggtggaaatctttcacctgaaccaaacaagtgtcttgctgacctgtgaaacccttaccctccctcctccacccctgtacctcccacatatctgcactgcagttctgagcttctcaccatggtaacctgtggacacaccagtccctctctgagctactgaaggtacagaccatattctactcatcgtggtttcatcagtgtttggcacagtacaagatcaaattaaaataagcagatcctgaattgcnaaatgaatgttccttatatagtgcttactcagcttttagatttattgccatctctacttctgtaccatctgcagggacgccgcccgttgaggtggtagagattggcttaaggttgtacaaacagagattggaaacttctttccctgacttgttctcattttactgtcatatttgccaataagcacttaaaatgccaactcacacagctgggtggaatatcttaaggaaagtaaatgagacagtgtatacatgtaagatgatatacaataaaagatgatacggagtaatgtgaaaacaaaagatagtattattactgttgtttaagcaagc

SEQ ID NO: 766 - DNA, 661 bp, Homo sapiens
  LOC285768
  misc_feature [331]..[331]: Chromosome 6, SNP identification no. = rs7770094
  misc_feature [331]..[331]: allele = g, in linkage disequilibrium with rs9328033, respectively
  misc_feature [331]..[331]: n is a, t, c or g
gccaaggtggaaatctttcacctgaaccaaacaagtgtcttgctgacctgtgaaacccttaccctccctcctccacccctgtacctcccacatatctgcactgcagttctgagcttctcaccatggtaacctgtggacacaccagtccctctctgagctactgaaggtacagaccatattctactcatcgtggtttcatcagtgtttggcacagtacaagatcaaattaaaataagcagatcctgaattgctaaatgaatgttccttatatagtgcttactcagcttttagatttattgccatctctacttctgtaccatctgcagggacnccgcccgttgaggtggtagagattggcttaaggttgtacaaacagagattggaaacttctttccctgacttgttctcattttactgtcatatttgccaataagcacttaaaatgccaactcacacagctgggtggaatatcttaaggaaagtaaatgagacagtgtatacatgtaagatgatatacaataaaagatgatacggagtaatgtgaaaacaaaagatagtattattactgttgtttaagcaagcctcaggccttttagctagcaaagcttcatccagtaactgctcactttgtcttaagcactgtagttttattctgaatgaa

SEQ ID NO: 767 - DNA, 661 bp, Homo sapiens
  LOC285768
  misc_feature [331]..[331]: Chromosome 6, SNP identification no. = rs10900904
  misc_feature [331]..[331]: allele = a, in linkage disequilibrium with rs9328033, respectively
  misc_feature [331]..[331]: n is a, t, c or g
tacagaccatattctactcatcgtggtttcatcagtgtttggcacagtacaagatcaaattaaaataagcagatcctgaattgctaaatgaatgttccttatatagtgcttactcagcttttagatttattgccatctctacttctgtaccatctgcagggacgccgcccgttgaggtggtagagattggcttaaggttgtacaaacagagattggaaacttctttccctgacttgttctcattttactgtcatatttgccaataagcacttaaaatgccaactcacacagctgggtggaatatcttaaggaaagtaaatgagacagtgtntacatgtaagatgatatacaataaaagatgatacggagtaatgtgaaaacaaaagatagtattattactgttgtttaagcaagcctcaggccttttagctagcaaagcttcatccagtaactgctcactttgtcttaagcactgtagttttattctgaatgaaaaatatatttacatacctcctcttaaaatcatagttcaagtttaattctcaagatcaagatttattctgcttaataaaactcatttctaatttttttctaacctaataactggtgttctaaatgctaatcttcttagaatgcacttctcctcaaatccaatgtgtcg

SEQ ID NO: 768 - DNA, 661 bp, Homo sapiens
  LOC285768
  misc_feature [331]..[331]: Chromosome 6, SNP identification no. = rs10458112
  misc_feature [331]..[331]: allele = t, in linkage disequilibrium with rs9328033, respectively
  misc_feature [331]..[331]: n is a, t, c or g
aatgaatgttccttatatagtgcttactcagcttttagatttattgccatctctacttctgtaccatctgcagggacgccgcccgttgaggtggtagagattggcttaaggttgtacaaacagagattggaaacttctttccctgacttgttctcattttactgtcatatttgccaataagcacttaaaatgccaactcacacagctgggtggaatatcttaaggaaagtaaatgagacagtgtatacatgtaagatgatatacaataaaagatgatacggagtaatgtgaaaacaaaagatagtattattactgttgtttaagcaagccncaggccttttagctagcaaagcttcatccagtaactgctcactttgtcttaagcactgtagttttattctgaatgaaaaatatatttacatacctcctcttaaaatcatagttcaagtttaattctcaagatcaagatttattctgcttaataaaactcatttctaatttttttctaacctaataactggtgttctaaatgctaatcttcttagaatgcacttctcctcaaatccaatgtgtcgcctctcccagtgaatcactggcttagaaataatgatggcaaacctatattacatgcttaataggtgccaggcacccttgtaaatac

SEQ ID NO: 769 - DNA, 661 bp, Homo sapiens
  LOC285768
  misc_feature [331]..[331]: Chromosome 6, SNP identification no. = rs6596783
  misc_feature [331]..[331]: allele = c, in linkage disequilibrium with rs9328033, respectively
  misc_feature [331]..[331]: n is a, t, c or g
tatttttgaatgactttagtttcttttcaacataggtaacacatcacctggtttaaaaaaaaattctagaaggcatgctgtaaggagtcttgcttctactctggtcctgcctgttttctctttgcccactcctgaccccaactctaatacgcagttgacaacttttagtagtttctggaatatacctttggagattttaatgaaaatgcaagcacatgcaaatatatgctttttgtttcttctaccttccttccacaaaatgtagtatgctctacacacctttttttctctgttatttatatatctcatagctctttccatagcaggatanaaatccttctcattcttttatgctgcatattctgtcacatgactgtgtcatgatttaaccagttcaggattgatggacactttcagttcttgtctattcacacagtacagtcatgaatgatcttgatgttcatcttttcctatgtgtaagtgtatctgttgggtaaatttccagaggtggtacttccaggttgaaagattcttgatttttcagcttttatgatttcgtaacattcctggatttcccttcaattagcacattttcctgcagattgtgtaaacatctatttattcttatggcctcatctgcagaatgtgctgtcacactttg

SEQ ID NO: 770 - DNA, 661 bp, Homo sapiens
  LOC285768
  misc_feature [331]..[331]: Chromosome 6, SNP identification no. = rs6914197
  misc_feature [331]..[331]: allele = g, in linkage disequilibrium with rs9328033, respectively
  misc_feature [331]..[331]: n is a, t, c or g
caggattgatggacactttcagttcttgtctattcacacagtacagtcatgaatgatcttgatgttcatcttttcctatgtgtaagtgtatctgttgggtaaatttccagaggtggtacttccaggttgaaagattcttgatttttcagcttttatgatttcgtaacattcctggatttcccttcaattagcacattttcctgcagattgtgtaaacatctatttattcttatggcctcatctgcagaatgtgctgtcacactttgaatttttgcccattttataggtgataaaagatattctcattgaattcacatttatcttattatgnatgaggttgaacaccttctcatacatttagggcttgtttattatattttataaataagctattctaccctttgacaatttttcaattggtttgttggttttttacttagtgaaactagagatattcttttaactattttgcagtagtgattcccaagaaagagtgaagacattaataaaggaaattgccataaacacaataggttatcaaaattgttttaggtacaagttaaaagacttctctggttacttttgactttaaactctatcatatgaaataatgtatatcaaaagttctacaaactctagtctgttagttattcattattat

SEQ ID NO: 771 - DNA, 661 bp, Homo sapiens
  LOC285768
  misc_feature [331]..[331]: Chromosome 6, SNP identification no. = rs9405441
  misc_feature [331]..[331]: allele = c, in linkage disequilibrium with rs9328033, respectively
  misc_feature [331]..[331]: n is a, t, c or g
tgggattacaggtatgagccactgtgcccggccaggtatatctttacaatgtgtaagtttctaacctttccccttttccctggtctggggaaaggtagaggctggttccagagctgatcccagggcctttgtgagctcagatatgcagtaatggcataggaccatctgccaggtcaaggtgtttgctgcctctgtggttatttggttataaagagccagcaaagccaggagacctctctgaaaaagatacacatagagcctaatatgtgaagtcgtttatattttgtatgaataaacatacttaatacacatttacacatacatactaaangcagtatgaaccaaatgcttacaggagacagggcatgtgtatgggcataagactttggagagaaactctgaagtccacagaaccctcccatgggtcaagatcaaatgcctaccagatgctcagagcctccagtaaatccagtcagagctggatttgagtagaagattcccttttatgcacaactgctgacataagtggcgtgacacttccttatttatgtctggagtttactgccctttgagtttattgcctaatacagcatggccacagaatgtctttttcaacgcaaaggcctataattctattacaagaacaccttggggatattgt

SEQ ID NO: 772 - DNA, 661 bp, Homo sapiens
  LOC285768
  misc_feature [331]..[331]: Chromosome 6, SNP identification no. = rs6911992
  misc_feature [331]..[331]: allele = t, in linkage disequilibrium with rs9328033, respectively
  misc_feature [331]..[331]: n is a, t, c or g
cctataattctattacaagaacaccttggggatattgtgggttcagttctagaccatcacaataaagcaaatattgcaataaagcaagtcacacaaattttggtgtttcccagtgcatataagagttatgtttatgctatactgtagtcctttaagtgtgtaatagcattatgtttaaaaacacaatagtgtgaaaaaacccgcaatatctgcaaagcacaataaagcgaactgcagtaaaataaggtatgcctgtatattttttaaatgcacttgagcctttctaacccctttgagaattaagaagcagtttgcacaccctctgcaatcnaaaatggatcccacatctatgcacacacatgcaggactaggttcatgtattgtataacccacacagtcaagtcctgcaagattcaataaaaacctgtagtcaggttcattctatttcagatgcagaaattgtttgtaatgaatgaaaaatgaacactattagccacgtgcttttataattcactagataacatatgaaaccactaatgttgtccactaacgatgactaccatcatgaccaacacaacaaaaccagaaacagtatttcctcctttttttttttttttttttgagacagtcttgccaccaggctggagtgcagtagcactat

SEQ ID NO: 773 - DNA, 661 bp, Homo sapiens
  misc_feature [331]..[331]: Chromosome 6, SNP identification no. = rs9354792
  misc_feature [331]..[331]: allele = a, in linkage disequilibrium with rs10484791, respectively
  misc_feature [331]..[331]: n is a, t, c or g
ttgcatgtgacatgagtctcttgaagacaacatagagttgggtcttggttcgttatccagcttgcgactctgtgacttttaagtggggcatttagcccattaatgttcaaagttggtgtggatttggccctgtcattatttttttagctggttattttgcagacttgattgtatatttgctttatggggtcaatggcttatgtacttaagtgtgtttttgtggtagctaacagtggtctttcatttccatgtttagcactccattatggacctcttataaggcatgtccagtggtaataaatttccttagcatttctttgtctgaaaaagntctgatttctccttcacttttgaagattagtttggctggatgtgaaattcttggttggaatttctcttttttaagaatgttgactatagaccctcaatctcttctagtttgtgctgtttttggtgaaaggtacactgttagtctaatggaattctgtttgtaggtgatgtgcctcttctctctaacagcttttaatacattttttctttaacatggaccttggagatgaccatgtgtcttgaagatggtcatcttgtatagtatctctgcatttcctgaatttgaaagtcagcctctttattgaggttggggaaatttttgtggacagta

SEQ ID NO: 774 - DNA, 661 bp, Homo sapiens
  misc_feature [331]..[331]: Chromosome 6, SNP identification no. = rs2585614
  misc_feature [331]..[331]: allele = t, in linkage disequilibrium with rs10484791, respectively
  misc_feature [331]..[331]: n is a, t, c or g
taaaacctctgattttaaatccgtagtgaaagaagatgtcttatcattacccacttattaaagaagtacaacgtataaagaactaaatacttactctaagaaatctcaacacttgtctttaatgtatatatacatatatatattaaagtgttccttacaaacaaaaattttttatacttgtcaagtatcaaacttcttcttttataagtcttgatttgttttattctaaaaacaaatgttaataagtataacaacggatacgtatttatgtactcttatatacatgtgtcaacatagtaggacatatataaaacattgtatgaaagaattnaccttttcttttaaatttacgaagtaacttcactatataaaacggaaagttgaactttcgttaacttatcttttcgactatgatctcatactttggtaaatacattaggattttaagttttaataaaatatatatgttgtgtcttttgtttgtattgtcaaagttctatcccaaatggtggtcttttcctcctgtcttttttcctctcaccacacttacaagaatttcgataggcaactcacaataaaaaactatattattagaaactctgatttattatttatttattaacaggattttgtaatgaaaattttagaataaggggttaaa

SEQ ID NO: 775 - DNA, 661 bp, Homo sapiens
  BAI3
  misc_feature [331]..[331]: Chromosome 6, SNP identification no. = rs2246104
  misc_feature [331]..[331]: allele = t, in linkage disequilibrium with rs10484791, respectively
  misc_feature [331]..[331]: n is a, t, c or g
tgaaataaatgaaacaaaaaaactcaataggaaagacagcaataaataggttacagtaaaaaaaaacagaagtacatgactttgggaaagcatctaccttttacttacacctttattaggggaagattgctattatttttataatttccaattttattaatgcattattgatgtcagttcctgatctccaaggtgttattttaaaagtttttaaaataacaaggacttactaacaaatattcttaattatttatatgtttattttaaaatgtcaatgataaatagaacttgctatgtatgcccatctagaaaaaaaatggtaagaaaattngccattttctatctctttatttgacttcatttctctctctgtttctcttttctggccctagcattacttgtacagtaatgacattttgcaaatcctctcctccacactttgaagataaacataagctgtctttccaagaaatagaaaagactatttatacatcagtttcagtgttactgttattcactcttgattatgatctatgttagtgatggaatattattaaaattataggcccggtcaagtataacaaaatgccacaattattccgtttgccatcttagaatttcaccaattaaggagtagttcatgtatgtagcaattaaagaa

SEQ ID NO: 776 - DNA, 661 bp, Homo sapiens
  BAI3
  misc_feature [331]..[331]: Chromosome 6, SNP identification no. = rs2585627
  misc_feature [331]..[331]: allele = t, in linkage disequilibrium with rs10484791, respectively
  misc_feature [331]..[331]: n is a, t, c or g
ctttctattaacttacatctcggacaccgtaaagtatctcagagtatctactataaaaatttaaaatggaatacttttatagtcttaagagtttaactacgattggtaaaaactaaaaaaaatcatagattaatacattcgtaacacccccctataagccctagtaaccagagattattgaatagtcttaagtgacttactttaaggtcgattcagtaggaaaaaaggttcacaaatttatacctgatcgtaaagttctattaaagaaaagttttatctagagttttgtatttggagtaaaacgtcttaggtcgtttctaattttatcagnctttagtaaattgaatttatcgaaacgacggctagtcgttactataagtttcctgtcgaaaggtccgggtcctactacgtgtgtggtgatagaactagattcagcacataataatcagtacggaagtagttgtgtttccataactctacaatggacaagaagtagattatgttttgtctgtgtatagagataccgaaatactaggaaacaatttacgagatttaagtatcagttcaagtttattaattcaccgtgagatttagtaataactaatagttaagagataccaaatatcggtttttattcttatttttgtttcaaaggttttga

SEQ ID NO: 777 - DNA, 661 bp, Homo sapiens
  BAI3
  misc_feature [331]..[331]: Chromosome 6, SNP identification no. = rs2585626
  misc_feature [331]..[331]: allele = c, in linkage disequilibrium with rs10484791, respectively
  misc_feature [331]..[331]: n is a, t, c or g
gtaattgcagactcatgtaaacgatgtaggatttataacgttagacctaggtagtcgcaaggttacagaaagagtacgggtataaacgagagaaagcttttttttttgtttttttgagtgtgaggggtttatttgaacaaaaaatcatctttattaaactcttttataaataggtcctaattcaatcgtccatttaataaagtaaaatgtactatctttgtctttggtttgtcattggtaaaatggaagtataaaatattgtacggagtccgtagtagtaacacactatccctgaccaatatcctttttacgtgtagtcgtttgtaaattntaaagtccttccgaggataagtaagtcaattaaaactcaattagtcgatgtacgagtacataaatcacgtaaacaatgaataacttaaaaggtatgtgtgatctttatgaaataatttgaaaatgtcggcacatcgatccagtaagagacgttcacgtgttttaaggacctcctatcaactttctattaacttacatctcggacaccgtaaagtatctcagagtatctactataaaaatttaaaatggaatacttttatagtcttaagagtttaactacgattggtaaaaactaaaaaaaatcatagattaatacattcgtaacaccccc

SEQ ID NO: 778 - DNA, 661 bp, Homo sapiens
  BAI3
  misc_feature [331]..[331]: Chromosome 6, SNP identification no. = rs2802694
  misc_feature [331]..[331]: allele = g, in linkage disequilibrium with rs10484791, respectively
  misc_feature [331]..[331]: n is a, t, c or g
gtcactctagttgtccgttttactttgaacttgtcgttggttttaagataaaaataaaagtagaaaggtaaaaattttactatattttaatctgatttaagaattagacagtccttaaaaatacaaaatataccctcggaacttcattaaacaaaaacagtcgagtgtgtttaaagaaacttgtagatcccgtcacgtttacaaggtaacagagtagttatgacttttatttataatacatactacatatacttgcatacacataatacgttaaaaatttttaacactacgttaatttttttttggttgtctatttatggctttttttggntctcccggatttgagtttcttctcaataattctgtttgtgtataactataaaattaaaagttatgaagtaacaataaataaagagacatgtgaacgcgatgagacacgcgggtagacgttttccctattaataatgtattctggaaatcatgtaatttaccttcctggtgttatattttgtgactaaaggctaaataaaatatatatgagactttagtggagtgattgagttgatatgtggaaccacaatcagtcccagggtcattctttggacaacaagagttccataatactcttcgttcatgttgtcgtacttatcacgaaactcat

SEQ ID NO: 779 - DNA, 661 bp, Homo sapiens
  BAI3
  misc_feature [331]..[331]: Chromosome 6, SNP identification no. = rs2253759
  misc_feature [331]..[331]: allele = g, in linkage disequilibrium with rs10484791, respectively
  misc_feature [331]..[331]: n is a, t, c or g
atttaagctagcaaaattagactatctgggaaggggaatagggaaccagatgccttaatgggaccatgatgaggcttctgcagtaatccaaaaataaattgattacaacagaagtaattgaaaaacaatgatgaaaagcagtgtgatcagtttgagacatttaaagtgacaagggatcataaattttttaaacaaagtaccagagggaaataaaaggcttcacttttgatgattgtgatattggcacaagtcaggaatttgcaaaggggagctggttcaagtcgagccaagtatggtgcagaaatgatgagtgtgaggttttggcagatanttaaattggcaatgtcctgtgtaaaaacaaatagaatttgatattatagctctgtcacttaatggctatggatttaccacataacaaattaacaaatctgagcagcttagaatagtccttttcatgtaattttagtgcttactaattttggggaaaatatgaaaccattggagaggggagtctaagttaattttcagaggtaaatttattttacattatcaataagaaaaataatctaagataaagagagaatttaagtgaagttcccaggatagggcgagattttgggtattattccaatttagtcaaatattgaaaagaaaaatcaga

SEQ ID NO: 780 - DNA, 661 bp, Homo sapiens
  BAI3
  misc_feature [331]..[331]: Chromosome 6, SNP identification no. = rs2253866
  misc_feature [331]..[331]: allele = a, in linkage disequilibrium with rs10484791, respectively
  misc_feature [331]..[331]: n is a, t, c or g
gtattattccaatttagtcaaatattgaaaagaaaaatcagaatactgaggcttaagtaaggaatgttttgtgaataattaaagctgtggtcacaggtcatgcgttttagaagttgtattaaaaattataaaaaaatttctttcaatatctgttaaacaattgctttaggagtctgagttaaagataaaagttgtattctagtgtccgtacacaaaagtgataaatgagtatatctcaaaacagtattagaatataaaattcatctgctatagaaactttagaacacaatgtatcatctataaaaatattatttgtagctttaaaaatcanttatgcatatatgttaatgttatcccaagagaatcatgaaaatagtatttagtgcctttctttattgactcgatttgacaaattaactacaaaaccactattttggaactactcacttctaaggaaaatgggaagacaaaaaaaattaactcccaaggtttccagaattgctattatttatattataatatatagtataagtttttttctgatattatataaactttttggttaaatagataataactttctagtaaacccattacgtcagctttcaacaatgttatatggaagtcagctttcaacaatattatatggaaaagtaaatcg

SEQ ID NO: 781 - DNA, 661 bp, Homo sapiens
  BAI3
  misc_feature [331]..[331]: Chromosome 6, SNP identification no. = rs2802689
  misc_feature [331]..[331]: allele = a, in linkage disequilibrium with rs10484791, respectively
  misc_feature [331]..[331]: n is a, t, c or g
agttcaaattttgaggtttttattaattattttatatttataaaaagttcatgatcttatattaaaacataaaatatactaaataatacgtttaaaccatttagtgtgtaaaaattttagatttactttcgaactaagtttttagtccttcgtgaaggttgttgaaaagttttacccagattacctcgtctcatgatttttaatatactacttgtgtttgatattaaataacaaatgtttacgttacttttaagaatgagttttaaatcagaagaaacataaataaatactttgaaatccttttacttaactttattgtctccattcagtnttattttattttcaacaaatttacaaatagaatacataaagctaaatgaaaaggtatattataacaactttcgactgaaggtatattgtaacaactttcgactgcattacccaaatgatctttcaataatagataaattggtttttcaaatatattatagtctttttttgaatatgatatataatattatatttattatcgttaagacctttggaaccctcaattaaaaaaaacagaagggtaaaaggaatcttcactcatcaaggttttatcaccaaaacatcaattaaacagtttagctcagttatttctttccgtgatttatgataa

SEQ ID NO: 782 - DNA, 661 bp, Homo sapiens
  BAI3
  misc_feature [331]..[331]: Chromosome 6, SNP identification no. = rs2585622
  misc_feature [331]..[331]: allele = g, in linkage disequilibrium with rs10484791, respectively
  misc_feature [331]..[331]: n is a, t, c or g
tgtatgtatgtaagtgtttataaaagagtcacgatcgaggaaacaatccacaagggtaggattttaattaaatctgtagagaataagtggtctggtgtccttctttatatgttacgatgccctactaatgaaatatttcaaaaggaataacattgttctcttggactagttgaaaccccctcaggcctcttcagagaaggtctttcactatgaatcccattcttcactttctacccatacacaattaatatgaaacctccatctctcttttctttgagctccaagatcatttccattatcgaatatatacccggaatttcgtaatttttcnccattgtcattcgatcgtccgctactcctacttctgacctttcttctcgtaaagggtggtaaggtttgaattcttttaatgtcccttgagaccaggatctcttatttgtggtagaaagaaccgtatgttcaattaatcaagtgttaaacttttatttaataaaggatatagattttttgatacttatactcaaaactgtataaagaagtaatttgactatcctttaatataggagttttaggtatttttacttatgttaatggtttcctttttcttgaacacgactaatatcgtctatactacctaacctcgagtgacagataatatcga

SEQ ID NO: 783 - DNA, 661 bp, Homo sapiens
  BAI3
  misc_feature [331]..[331]: Chromosome 6, SNP identification no. = rs2585621
  misc_feature [331]..[331]: allele = c, in linkage disequilibrium with rs10484791, respectively
  misc_feature [331]..[331]: n is a, t, c or g
tacgcgagtgtgtaaaaaaatttttaatatttttatttatgtatgtatgtaagtgtttataaaagagtcacgatcgaggaaacaatccacaagggtaggattttaattaaatctgtagagaataagtggtctggtgtccttctttatatgttacgatgccctactaatgaaatatttcaaaaggaataacattgttctcttggactagttgaaaccccctcaggcctcttcagagaaggtctttcactatgaatcccattcttcactttctacccatacacaattaatatgaaacctccatctctcttttctttgagctccaagatcattnccattatcgaatatatacccggaatttcgtaatttttcaccattgtcattcgatcgtccgctactcctacttctgacctttcttctcgtaaagggtggtaaggtttgaattcttttaatgtcccttgagaccaggatctcttatttgtggtagaaagaaccgtatgttcaattaatcaagtgttaaacttttatttaataaaggatatagattttttgatacttatactcaaaactgtataaagaagtaatttgactatcctttaatataggagttttaggtatttttacttatgttaatggtttcctttttcttgaacacgactaatat

SEQ ID NO: 784 - DNA, 661 bp, Homo sapiens
  BAI3
  misc_feature [331]..[331]: Chromosome 6, SNP identification no. = rs2254654
  misc_feature [331]..[331]: allele = a, in linkage disequilibrium with rs10484791, respectively
  misc_feature [331]..[331]: n is a, t, c or g
acctttactagaacctcgagtttcttttctctctacctccaaagtataattaacacatacccatctttcacttcttaccctaagtatcactttctggaagagacttctccggactcccccaaagttgatcaggttctcttgttacaataaggaaaactttataaagtaatcatcccgtagcattgtatatttcttcctgtggtctggtgaataagagatgtctaaattaattttaggatgggaacacctaacaaaggagctagcactgagaaaatatttgtgaatgtatgtatgtatttatttttataatttttaaaaaaatgtgtgagcncatggtaggtgtatatatttatgggatttatggaatacatgagatgtttccacaggcatgctatgtgaaataaggacgtcatggagaatgaggcatccatcccctcaagcatttatcctttgaggtacaaacaattcaattacactcttttagttttttaaaaatgtacaatgaaattattattgactacaattaccctgttgtgctattttatagcacaacatctgttctatttcttattcatttgttctaactatttcttttgtacccattagccatccgcatctacccctcaatcccccactacccttccctgcctctggtaaccat

SEQ ID NO: 785 - DNA, 661 bp, Homo sapiens
  BAI3
  misc_feature [331]..[331]: Chromosome 6, SNP identification no. = rs3121775
  misc_feature [331]..[331]: allele = g, in linkage disequilibrium with rs10484791, respectively
  misc_feature [331]..[331]: n is a, t, c or g
cccacaaataagtgagaacatgccatgtttgtctttctgtgctgagcttatttcacataacataatgatctccagtctcacccacgttgttgtaaatgacaggatcccagttttttatggatgaataatactccattgtgtgtgtgtgtgtgtgtgtgtgtgtgtgtgtgtgtgtgtgtgtgtataccaaattttctttatccattcatttttttgatggccacttaggttgcttccaaatcttagctattataaacagtcctgcaacaaacataggagtgctgatatctcttcgatgtattgatttcctttcttttgggtatatacccancagtgaatatggtagctcaatttttagatttttacagaacatccaaactgttgtccatagtggttttacaaacttacattcccacccacagtgtatgagacttccatttcctccacatccttgctagctgttgttattgtctctttttgatataagccattttaactggggtgagattatatctcattgtagttttgatttgcatttatctgatgatcagtgatgttgagcacattttagtatgtctgtttgccatttgtgttctttcttttgagaaatgtctattcaaatcttttgcccattttttgattgggttattggatttttttc

SEQ ID NO: 786 - DNA, 661 bp, Homo sapiens
  BAI3
  misc_feature [331]..[331]: Chromosome 6, SNP identification no. = rs6931872
  misc_feature [331]..[331]: allele = c, in linkage disequilibrium with rs10484791, respectively
  misc_feature [331]..[331]: n is a, t, c or g
agttccttatatattctggttattaatcccttgtcagatgggtagtttgtaaatatcttctcccactctgtgaattgtctctttacttcattgattgtatcctttgatgtgcagaagctttttcaactggatgtgagcccatttattttgccttggttgcctgtgcttgtagggtcttgctcaagaaacttttcactcagaccagtggccacaagattttccccagtgttttcttgtagtagtttcatagtttgaggtcttagatttaagtctttcattcattttgatttgatttttatacttgatgagagacagggatctagtgttgttnttctgcatatggatatccagttttcccagtaacattttttgaaaagactgtcttttttctccaatggatgtttttggcaactttgttgaaaatgagttcagtataggtgtgtgggttctctcttctgttccatgagtctatgtttctgttttttatgccagtaccatgctgttttggtgactatagccctgtagcataatttgaagtcaggtaatgtgattcttccagttttgttctttttgcttaggatagctttagcttttctgggtcttttgtggttccatacaaatttttggatcttttttctatttctgtaaagaatgtcattgg

SEQ ID NO: 787 - DNA, 661 bp, Homo sapiens
  BAI3
  misc_feature [331]..[331]: Chromosome 6, SNP identification no. = rs2585592
  misc_feature [331]..[331]: allele = g, in linkage disequilibrium with rs10484791, respectively
  misc_feature [331]..[331]: n is a, t, c or g
gtttgtaaatatcttctcccactctgtgaattgtctctttacttcattgattgtatcctttgatgtgcagaagctttttcaactggatgtgagcccatttattttgccttggttgcctgtgcttgtagggtcttgctcaagaaacttttcactcagaccagtggccacaagattttccccagtgttttcttgtagtagtttcatagtttgaggtcttagatttaagtctttcattcattttgatttgatttttatacttgatgagagacagggatctagtgttgttgttctgcatatggatatccagttttcccagtaacattttttgaanagactgtcttttttctccaatggatgtttttggcaactttgttgaaaatgagttcagtataggtgtgtgggttctctcttctgttccatgagtctatgtttctgttttttatgccagtaccatgctgttttggtgactatagccctgtagcataatttgaagtcaggtaatgtgattcttccagttttgttctttttgcttaggatagctttagcttttctgggtcttttgtggttccatacaaatttttggatcttttttctatttctgtaaagaatgtcattggtattttgatagggatttcattgaatctgtggattgctttgagta

SEQ ID NO: 788 - DNA, 661 bp, Homo sapiens
  BAI3
  misc_feature [331]..[331]: Chromosome 6, SNP identification no. = rs7754835
  misc_feature [331]..[331]: allele = c, in linkage disequilibrium with rs10484791, respectively
  misc_feature [331]..[331]: n is a, t, c or g
gttaattcctaagtatttaatttgatgtgtggttattgtaaatgggattactttttaaatttatttttcagattgttcactgtcggtatgtaaaaatgctactaaattttgtatgttgatgttgtatcctgcatctttactgaatttttatcagttctaattgttttctgggggaatctaggttttcctaaatataagattatatcatctgtaaacatggataatttgacttctccctttccaatttggatgtcctgtgtttctttctcttgtcggattgctctaggtaggacttctaatactatgttgaataacagtggtgacagtgggnaaccttgttgttttccaagtcttaggggaaaggctttcagtttttccccattcaatatgatactagctgtgggtctgtcatatatcacctttactgtgttaaggcatattccttctatctcaagttttctgagggtttttatcatgaagggatttcgaactttatcaaatgcttctttcagcatcaattaaaatgatcatatggcttttatcttttattttcttgttatgatgtatcatattgagtgatttgcatatgttgaatcatctttctgtcccaggaataaatcccacttagtcatgatgaatgctctttttaatgtattgttga

SEQ ID NO: 789 - DNA, 661 bp, Homo sapiens
  BAI3
  misc_feature [331]..[331]: Chromosome 6, SNP identification no. = rs2746125
  misc_feature [331]..[331]: allele = g, in linkage disequilibrium with rs10484791, respectively
  misc_feature [331]..[331]: n is a, t, c or g
agattactctccataatatgggtaggcatcatccagtcagttgaagccttctgagaaaagactaaggtctcctcgcaaaaaagtacttctgcttccagattgtctttgaactggagctgcaatatcaactcttccctgcatcttcagaccacaggaatgccctgcagattttacacttgctagcctccacaattatgtgagccaaaattccttaaactgaatctctctctctctctctctcagtaggtgtgtgtgtatacgtatgtgtttgtttgcatctgtctgtgtgtatgtttgtgtatgttaggtgcaataataattaaatgacaanaacgattaaagtcaccttcaagggttcgaatgggtataaaaataactgaaaataagtagagattcttatccttggtagataagttccctcatttccctttctgactaatagacagcatagaaggaagagagggaagtaacctaccaagttcaagaatctttatttactactagttatttacttctcatacaaaccctgggaagtaagtttaattactattgccatttaacaggagaaaaactcactcccagaaaagataatatgtacagcagtgtgtggtatgaagcaatgctgaaaactcagtgttatcagtctccataacctctgtta

SEQ ID NO: 790 - DNA, 661 bp, Homo sapiens
  BAI3
  misc_feature [331]..[331]: Chromosome 6, SNP identification no. = rs2746127
  misc_feature [331]..[331]: allele = g, in linkage disequilibrium with rs10484791, respectively
  misc_feature [331]..[331]: n is a, t, c or g
atactataaaataagggacagccttcaaagtccaaagccaaagtcatttctaaagatctctattatttagaagttccctggaaagcatctcacacctatttttagaatcataggatatgatgaccttaagacactatactagaggcaatttatctgaggctgtctgagtggttggcatcttatacagttagagagagaaaggattttctgatgttaatagtgtgctttctttgattgatttttgtttggaatgctgtcaaaatattttaggtaataacatgaattagttgcaacgtaacatgattttaaaagctaaaaaaattttagacgncatgaaacattgtaagacaatagaagggaatttttttgccacaaatagtgataaaaatattatacattaaaaatgcaaccacttttacacaaacatgcataaataaatgtactagatgtcacaggggaaattcaaatgaaaatcttatttttctatttttgagatgtttaccacttattaggcgtgacaaagcaaatacaaaggaaatgttagaagaactagaatttaatcacagcttgaaagagctataaatacggtactactcttggtttatcatgcaaagggaaaatcgatttcaagtccaggtgacctatgagctataccttgaag

SEQ ID NO: 791 - DNA, 661 bp, Homo sapiens
  BAI3
  misc_feature [331]..[331]: Chromosome 6, SNP identification no. = rs2585597
  misc_feature [331]..[331]: allele = t, in linkage disequilibrium with rs10484791, respectively
  misc_feature [331]..[331]: n is a, t, c or g
atagccttctccatttatcacaagtcccacccttcccggaaagtatgatgcagagaccttgtccaccccttcagcccctataaactgttgagcttgtgatccttgctttagaacatataaaagacaggtggatagaatgaaaaactgtgaggggtaatagctgacttcattcagaatatgggtgtaatcaaaggaaggttggatgaagtaaatgatctgaaattgaggaatatatccaggtttagatcatttaaagaattcctgcctttggatctaacagccagttttgcatctatttgtgtgtgtgtgtgtgtgaattgctcatattcangtaatttcactttgatttttgttacgtaagattgatcgtattgttataaaaataataacactgtattgattccaggattcagtgaaactcttgaatttaataattaaaataataatgctaatagtagtaataacaatatcagagaaacattataatgataataaaacatttcaaaaaggatattacttcaagttgtccaatgacttacctgacatgttttgaagttatgcacacaaatacaaatggtggctttttgtaattcaatttaaaaaatttcttatcctattttactgagttattctgatttttacattctataaattatttctc

SEQ ID NO: 792 - DNA, 661 bp, Homo sapiens
  BAI3
  misc_feature [331]..[331]: Chromosome 6, SNP identification no. = rs2746141
  misc_feature [331]..[331]: allele = c, in linkage disequilibrium with rs10484791, respectively
  misc_feature [331]..[331]: n is a, t, c or g
taaaggaatactggaggttgagtaatttataaagaaaataaatttatttggctcacagtctgcaagctgtaccagaagcatgatataagtatctctttttggtaagggcctcaagaagctttcatcatggaggaaggctaaggggaataggcagaaagaagagggcaaaggagagtgagcaaagaggtgtgtcacctttttgaataaccagctctaactaatagagctagaatgcactcattatggtggagaggacaccaagccattcatgaaaaacttcccttacaacccaaatacctcccactagactgcaccttcaacatcattgggnatcaaatttcaaaataggtttttgaggggacaaatatccaaactatatcatgccactttattttattttattttgttttgtagagacagcatctccctttgtttcccaggttgggctcaagtgattctcccacctcagccccccatgcagctaggactacaagcatgtgccaccacatctggccaatctttctcatttttgtagagatggggtctcgcgatgttgctcagtctggtctcaaacttccggcctcaagaagtcctttcaccatggcctcccaaagtgctgagattacagcagttagtcaccacacctggctccattgtgcca

SEQ ID NO: 793 - DNA, 661 bp, Homo sapiens
  BAI3
  misc_feature [331]..[331]: Chromosome 6, SNP identification no. = rs2585598
  misc_feature [331]..[331]: allele = a, in linkage disequilibrium with rs10484791, respectively
  misc_feature [331]..[331]: n is a, t, c or g
gaagataaaagctgttgtataaatataaagcaagataacaatcagggtagcctgaaggttgaaatcgaaccaaagaaaataaattcagaacaacaaattactgtaatacttttatttaatttgataactttcaatcatataatgcactgcacaagttatttggcaagaacaaaaatagtgtagaaactcatatcttaccatatatcaaattaagtttcagaaatattgttagttaaaagaaataaaaaattataattcttcgtaaaatttatcagactatgctgttagcagcaatagcactatttatcatgaaagtcaaaggaagggaccntaatgaaataactatatttgactccacacaattaaaaattttgtataacaaacaccacaaataaaatgacagaggacacataaggagttgatgcaatgttttctttttctttcacttttttttttcttttttttttgagatggagtctccctcttgacgcccaggctggagtgttgtggcacaatctcagctcactgcaacctctgcttcccgggttcaagtgattctcctgcctcagcctcccaagtagctgggattataggcacctaccaccacgcctgactaatttttgtattcttagtagtgacagggttttgccattcactgtgt

SEQ ID NO: 794 - DNA, 661 bp, Homo sapiens
  BAI3
  misc_feature [331]..[331]: Chromosome 6, SNP identification no. = rs2802684
  misc_feature [331]..[331]: allele = g, in linkage disequilibrium with rs10484791, respectively
  misc_feature [331]..[331]: n is a, t, c or g
aggagttcccggtgtatctctattgtaatataaagagagaaagacttacacaaaccgtccttaccactttttaatataacaagaagatgattttggatcacatggaatcactgattacatggtgtcttttgagtaaaatacgtatgattgtgacctctttttattagaacccttgaacgtccataaaaagtgtacttttgtttcatataatttcatgtaaaagtaagagtatcgtgaaagaaaaaaagggagtgtctagaatagtcttaacaatcaacatgtaaatagacacactcaatgtaaagacaaaaaaaggagactttccactgcnaggatcacttaccatgtattatttatgtgtcattcacaaacaactaataagtacttacttactcacttacttacttacgaccgattaatacacgaattaagtacattccgttatctttgttcataccggtgttaaaaaaaataaacttttcttctatggatcgagtaaaggttttaaatctgtgtttgtatgtaccgttttatacgtagcgtatatggacttttgactatggaatcggaagaaccacggagtttggtctaggacaagtctgtacaatattatttaataatattcgaataaaaccacgtttttgtaacgtttaggtacgta

SEQ ID NO: 795 - DNA, 661 bp, Homo sapiens
  BAI3
  misc_feature [331]..[331]: Chromosome 6, SNP identification no. = rs2802683
  misc_feature [331]..[331]: allele = g, in linkage disequilibrium with rs10484791, respectively
  misc_feature [331]..[331]: n is a, t, c or g
ctgcataccagtctcaattcagtgggagattcccaaaggagtccatttgggaacctcccacagtagacacagaaccaccttgaggttatgttccgtaaaaaccttctttagatattagactgtctcattttattctttactaatcctgttaccccttagtaattacgttcctaatttattacggtctcttttacaatctgaagtctttaggtaaggttagttcaggacaccagacaacaatttccacgcaagatttaaactaagattcgaaagtctttgttctccaagtaaaggacacttcagttgtttcgaattcgaagtcctggaaagngaacgtctcctgagggttccgggaccctcccctggattatttatacaaatgtactattaagtaaaaacattttaaatgtgtttactctataaagtcaatattaattatttctggtaacagagaaaggttcttttgcaatagggacaatgtaagaggggaggatgactcaccgatttgttaccggcacccattaaactctaggtcaacaccacttccactcaaaacctaagaaatataaacccaaaacatcttagaagagatctacgaactacaaacccgtttatagttcataagttgagttgattcaaatccaaccacctcccctttaat

SEQ ID NO: 796 - DNA, 661 bp, Homo sapiens
  BAI3
  misc_feature [331]..[331]: Chromosome 6, SNP identification no. = rs2585599
  misc_feature [331]..[331]: allele = c, in linkage disequilibrium with rs10484791, respectively
  misc_feature [331]..[331]: n is a, t, c or g
actctggtgctctgtcccttttttgatggtcattctcttgtctccagcctacattaggaaaaggaaatgagtattttgaactttcctaactcccaataactgctcctgtccctcatctctagattctatcccttcaccactatcttcttgctccctaggccagggttcctgtctttggagaaagcatcagtctttttaaacaccattctcccaagcattgtggttaataccttggacttctttttatgtctctatgggtttagggttttagaaatcaaagtcagcaatactcatccttttctgtattgggccattttatatcccctcttangaggtaataggcatcgtatagtctattttcagtgatatctaataaaacttgtgatgatggaaatagctacatgtggcaactgagcacctgaagtgtggctaatgtgactgagagagtgaagttttaattatattcagttttaattattttaatttaaatggctacatgtggctagtggctgcagtatgagatagcacagatagctgcttgaatgtagagaaatgacaaaggggagcaatatgataaaggtgaggcttttaaaaaatggctataattgaaaaatatcatccagtcctgaaatcatatcagagaatttcttttgacatctgt

SEQ ID NO: 797 - DNA, 661 bp, Homo sapiens
  BAI3
  misc_feature [331]..[331]: Chromosome 6, SNP identification no. = rs2802680
  misc_feature [331]..[331]: allele = c, in linkage disequilibrium with rs10484791, respectively
  misc_feature [331]..[331]: n is a, t, c or g
ttccttgtaaaaggaggtacagtcttattattatgtagttcaagtccttaaaggaataggtttttgaaagcaattaagtcaacactaaaactaaaatgaaggtttaatccaacacgttttagggtatccaaaaaaaaaattaaaaatcttcttttcaccgtttacagttaaaagtttttatgtcctttgatatttttaaattttaggttgaatatctaccgaaataattgtaataatatatccggaaacatagaaattacgtcttttcatctctcatttttttttatgtaagtcgaaaattaaaggttttattcgtaaactaaggtgtcgntgtgttattagaattcacggttctaaatgaatttctcttttactctttaaggttttcaagggagatttataattcacaattagaaccgattaagcctagtgttttcgaatgacatttggtaactattgccctaaagtctcttcaagaccggtccgttcttctgcttacctttcggaagtctctcctccttcccctctaagtctatttgtcttggacttttctctgatgggggaaacccagcgtcggtttatgtccttccgcgattcttttaggtgttgtttttaggatctatacgtttacccccttcggttcttgtagactcttaggtcg

SEQ ID NO: 798 - DNA, 661 bp, Homo sapiens
  BAI3
  misc_feature [331]..[331]: Chromosome 6, SNP identification no. = rs2585600
  misc_feature [331]..[331]: allele = c, in linkage disequilibrium with rs10484791, respectively
  misc_feature [331]..[331]: n is a, t, c or g
gtcgctgtggaatcaaatgcttattttggaaattaaaagctgaatgtatttttttttactctctacttttctgcattaaagatacaaaggcctatataataatgttaataaagccatctataagttggattttaaatttttatagtttcctgtatttttgaaaattgacatttgccacttttcttctaaaaattaaaaaaaaaacctatgggattttgcacaacctaatttggaagtaaaatcaaaatcacaactgaattaacgaaagtttttggataaggaaattcctgaacttgatgtattattattctgacatggaggaaaatgttcnttatgagctccttctaggacatttacatttataatataataagaataatttttttcacattatatgacaaatttatataattttttctaatgattaccagtaattaaatgtcagtttctaacttggctccaaatagttaaattttaaactattttaacaatcataaagtgttcaggtcctttagtcaaggacaattaaccatttatttttatattacaggaggtcaacatgaagcaaatttagacaaattgtagttaactttgcataagcattttctttaaagaaaatctgtaaactccagactactttgattaatttaaaaacctttcg

SEQ ID NO: 799 - DNA, 661 bp, Homo sapiens
  BAI3
  misc_feature [331]..[331]: Chromosome 6, SNP identification no. = rs2585604
  misc_feature [331]..[331]: allele = c, in linkage disequilibrium with rs10484791, respectively
  misc_feature [331]..[331]: n is a, t, c or g
aaatatgtaggatttgcttttgttttctggatacatatgtatgtggctagaacttgtacagaattcatgtgacttttggccattattgcagggtatttaaaatagacctatgtttttctaaatattttaaatttggcattttggctattcaatattgttaacttatgttaaaatgcatcagatataagatgcattgatgggtggttggaaagattaatgaaggataggtattaaccaacaagtatggtaaaatgttagtagtaaaatcaaggtgatgggtatataactgtttactgtaaaataacttcaactctactgtatgttttaaagnggccataatgttgaacaaattaaattttgtggatttcaaaacaatcttttttatcactcagaattaataatttagagttataaattaatatttttgcttcccttaatttggtaaaaattgaaaagcaagcttaaatacaacataaacactctcccataagctactaccattgtgtgggtcaaagaagtataattttgaaattttgagcgtatcaatttatagtcataaaggtcagattcagacttgaatttaactatatatatgtttctataatttatacaataattctactccagaagaattatttttcaacactgattttgtaaatta

SEQ ID NO: 800 - DNA, 661 bp, Homo sapiens
  BAI3
  misc_feature [331]..[331]: Chromosome 6, SNP identification no. = rs2746132
  misc_feature [331]..[331]: allele = c, in linkage disequilibrium with rs10484791, respectively
  misc_feature [331]..[331]: n is a, t, c or g
tttaacagcaacaaatttgaattcacctactttaaagctttttgctgtttttagaaaatatttctatcaataactttgagattagaagtctattaaggtcacagttcacagtctcataacacaatattctgatattttccccttctgactgaattcatgagaaccaaattattttacttaagaggagcctacataaataagcagagtgtacatatttgctctaaaaagaaaacaaacaagaactttgaaatgtccagtttaattggagtccacaggtatgtataattatgctttgatttgataaatcagtgctaaataatctgtgaaaacnttgctttgtggcaaagggctccttttagcaggtaaagcttgaaattccatcaatgaaagtaaaatcctgtatcattaggtatagttttgtgtcaaatctaaatgaaacaaacagtctttgaaagctataacatctggttagtaatttagctatatcacaaacaatatttttaattacgctttaaacatatcagtctctatttattataattaaatatttagagaaatactgggaaaatattttttaaattacaaaatgcatttataaatagttaccagagaaaagaaagctacatttttgaaatgttgtatttaaaacaaatcacagatt

SEQ ID NO: 801 - DNA, 661 bp, Homo sapiens
  BAI3
  misc_feature [331]..[331]: Chromosome 6, SNP identification no. = rs715294
  misc_feature [331]..[331]: allele = a, in linkage disequilibrium with rs10484791, respectively
  misc_feature [331]..[331]: n is a, t, c or g
tcagtgaccacattgcttttttcatgtaaatgtctgggaatacctggagttgatccattcagctgctttaattaaaatatagggtaggtgttcatgtgttcattttatgtggagatttatttatttatttggacaatatttataagtgcaatctaattggaaagattgaattgttattatcctgcctgattcttgcaacttcttagcatgtccatgatcaagaaagaaccttgaagatattaaagttctcttcaactgtgggcccatgttttactggttctgtaatatagactgtattttccatatttatttggacccgctaaaatttgcntcacagctcattttttttttttttcctagagttgtaggggagcaactcagagcaacccacagagctagcatttctttccaactttgctttcaggaatatcacagtagtagcttgaaatcaccagtggtaggagtatttacaccatagatattgacaaacactgcaaataagagctctctccttcttcccttgcccacttcttaccttctgccctgaaagagctaattgttaaacttttttgagttcatcattgctcttaattcttttaccaggaagcttgctgacatatttaggtgatttgtggagagtctgcatccaggcaaaatgttt

SEQ ID NO: 802 - DNA, 661 bp, Homo sapiens
  BAI3
  misc_feature [331]..[331]: Chromosome 6, SNP identification no. = rs2802676
  misc_feature [331]..[331]: allele = a, in linkage disequilibrium with rs10484791, respectively
  misc_feature [331]..[331]: n is a, t, c or g
gagatttaaaccttaataatattttacgatacttaatatatatctatataacgatattcttggaaatattcttgacacgtacaaattgtgaattttgacaactatgccgtcttcattttaaaagggaatttttgaccggaaatgactttccaacaagttccgtttaacttcgttaaataactatttatacaatattttacatcaccatgaaaaactttctctcccggtaaagttgttttgtaagaactcatcttgaacttttgacggcttatagggtacatctttctattcgaggatgcactctttacttctttcggccgaaatagtgttncagagaagtaccttttatttcttgtactcttataattatttaggatattatttcttttttataaacttagaatttaaatgtccgagtatctttgatttagtaaaagtcttcagtctcgaatagagatcccttgtcctcctattttgtaaaacggacctacgtctgagaggtgtttagtggatttatacagtcgttcgaaggaccattttcttaattctcgttactacttgagttttttcaaattgttaatcgagaaagtcccgtcttccattcttcacccgttcccttcttcctctctcgagaataaacgtcacaaacagttatagatac

SEQ ID NO: 803 - DNA, 661 bp, Homo sapiens
  BAI3
  misc_feature [331]..[331]: Chromosome 6, SNP identification no. = rs12206222
  misc_feature [331]..[331]: allele = a, in linkage disequilibrium with rs10484791, respectively
  misc_feature [331]..[331]: n is a, t, c or g
atgccaacagggtaaatataaactctttttctattcctgccttagttggtttttaagtccgtgtccctgatgttattagtgcttcaatagaaccttctgtgatgatctgtatctatactgtattctgtatctatgctgtccagtgcaatagccactaggcctatatggctatggaacattttaggtatgactagtgtgaccgaataattgaatgttaactttattgaattttaattaatataaagttagttaaaattttgtagttagtgaccaccatattggacaatgtagataggggcacaaataattacacctcaaaacgaacagcatncaatgagagtgagagcgtaagataaattaatttaagtcatattataaattctataagagaactctgatgcctctgtttaattaacagttacacattggaaagatactctttgtgatccctagttgtgttttggctaagcgctcaatgtttagatgtgaagaaattagaaaccagttccaaaaattagaaaagctcttacagatacaatttctcttctcctattttctttttttttcttttgaatctataggaatcacaaaaaccttttttttagtggtctttcaacatttcattgatgatttggcatcaattcaaagagcaaatgatacc

SEQ ID NO: 804 - DNA, 661 bp, Homo sapiens
  BAI3
  misc_feature [331]..[331]: Chromosome 6, SNP identification no. = rs12210045
  misc_feature [331]..[331]: allele = g, in linkage disequilibrium with rs10484791, respectively
  misc_feature [331]..[331]: n is a, t, c or g
aggaagtcaaatgctgttggttctgtaggttttcccaggggtgaggataatttatcatctatcagcactatggattggatataccttggggctaagacatatttgtagaattgctgagatagaatacgacgtatagtttcaaatattagtatttactatttttttctaaagacattctttcaatacctattgcctcacattgtactatgtggagactatataaagaagtataaatcaagttggtcgccactacaaacggtggttctcaactggagattattttgcccccagcggacatttgtcaatgcttgataacatatttgagtgtcantatctaagaggtttgtactgacatctgttatcatctagtgagatttaaggatgttgctaattattttacaatgcacaggacaaccttccacatcaaagaaatatacagctcaacagtgttacagttgaaaaacatttacctagatgttaagacaaatgtaaataaattttagcatgaccgcagggtctctaataaaagtatacatgaaatattaaaaaaaaaaacaacctcagtggaaagattgtttttataccattgatttttaaattttatatggtgcttgttatgtactggtccagaaatgttgaagtcctgataaatactttccag

SEQ ID NO: 805 - DNA, 661 bp, Homo sapiens
  BAI3
  misc_feature [331]..[331]: Chromosome 6, SNP identification no. = rs10945138
  misc_feature [331]..[331]: allele = g, in linkage disequilibrium with rs10484791, respectively
  misc_feature [331]..[331]: n is a, t, c or g
ctaaatgtaccttgactatagtacagaaatgatatgccatctgatccatcatcaagataaacagaaagagtgctacatctcttgctggagagcttgatgaatactgtggctgtaaagtcagagcatgacgagtcagaatgatcagtatggatcagatccggagagatttctcttgccccatagatccatagcctgaattttacatggtatattggtgctctaaggcaggcaattaagggcgctaagccacttttgggtcctataagaatccccaagaatctctttcccaggctatttacagattcagggccaaaatttcgattattgctgngtggttgttgcaattactgttgctattatggtgacacttttcagaacacttatatcagtgctgtgctgagggaagcatagtcagataatggctttctctatgctttattgattccccatttacaaagacacatttttttcctatattcttacactgtagatcctacttctggacaccaaaaatctcttcggccaagttataaactggcaaagtactcttatgagctctggagatacaaagatgaataagaaactagctttgcctttgagaagcttataatctggtggaaaaggatgcttgaaaaaaatagtgttttggaaataaggctgt

SEQ ID NO: 806 - DNA, 661 bp, Homo sapiens
  BAI3
  misc_feature [331]..[331]: Chromosome 6, SNP identification no. = rs7768591
  misc_feature [331]..[331]: allele = c, in linkage disequilibrium with rs10484791, respectively
  misc_feature [331]..[331]: n is a, t, c or g
ggataaattcatatgcaattgactcttaactattaaagagttgtgaattatagagtattttttcattttccccatgttacttcttgctttttggtcgttgctaggctcattcttcttgcagttacagcagaataaaaggaaaccaaagacggtaaaactcaagagtcaattccataattttcaacaactcagttataaagagatgtagtcagggaaaacactaaaactaatggtttaaatgagacttttaaattatatgtagctttcattcatgcatgagtatcccagttttcaattagccaaaactctgtagttagcttttatttcagangttaatctacagattgagaaagtgcgctgctctctagcactgatgcctgcttggatatcaaacactggctttcagggttacattcagaaatggaggaaaagaacttaattattcagaaagtgaaagaaagcttatttggggagaaaacaaaaagaaataaggactgcagccaagcaacaagcaagtctaatgtgtttgagtaggtttgagaaaatataggaaagaaatgcaaaagatatataagttctttctttcaactatattataggttaaagaaattgaagaataataatgataataggacatatataacttactatttggtaaata

SEQ ID NO: 807 - DNA, 661 bp, Homo sapiens
  BAI3
  misc_feature [331]..[331]: Chromosome 6, SNP identification no. = rs11752837
  misc_feature [331]..[331]: allele = t, in linkage disequilibrium with rs10484791, respectively
  misc_feature [331]..[331]: n is a, t, c or g
ttttcacatgtttaagggatgtgtataatttttcaatggtatttttgtcattacttgatgtaaacctccattttgaatataagaacattgtttctcaataataagtgttttgattcctttgagctggaatcagaattgaagttcaggtcttcagactccaaaattgcaagttcttgccacttgttcccccatacaataagaatattattatcaagcactaaatagacaacaagaagtggagtgactgtagagacccaagattggaaagtgggttcaggagaactgtgggccctggaataagacagtccaaacataaattgtccatgttccnttatgagcttgtaatctcgtcgttctcaatgattacaaatcagctcagcttcctataaatgactcttccaaaggaaagccaaaaaaaaggttagactgaaagtcttcaacaataaatatttactgaattcttcctaccgggcaggtactacttcagggcctaagagcacaacaaagtagccaagaaatacctgctttatgagagttcagggtttagtgggtgaggccaaaaataaatatgttaatcaattaaatctatgcgtataatcacagttggtgaagtgttatgaagaaaaataaaggagaaagggaaaggtgttgctagggagaa

SEQ ID NO: 808 - DNA, 661 bp, Homo sapiens
  BAI3
  misc_feature [331]..[331]: Chromosome 6, SNP identification no. = rs11752398
  misc_feature [331]..[331]: allele = a, in linkage disequilibrium with rs10484791, respectively
  misc_feature [331]..[331]: n is a, t, c or g
catacaataagaatattattatcaagcactaaatagacaacaagaagtggagtgactgtagagacccaagattggaaagtgggttcaggagaactgtgggccctggaataagacagtccaaacataaattgtccatgttcctttatgagcttgtaatctcgtcgttctcaatgattacaaatcagctcagcttcctataaatgactcttccaaaggaaagccaaaaaaaaggttagactgaaagtcttcaacaataaatatttactgaattcttcctaccgggcaggtactacttcagggcctaagagcacaacaaagtagccaagaaatncctgctttatgagagttcagggtttagtgggtgaggccaaaaataaatatgttaatcaattaaatctatgcgtataatcacagttggtgaagtgttatgaagaaaaataaaggagaaagggaaaggtgttgctagggagaatggacaagtttgactaaagtgatcaagaaagaccttactaagaagaaattgagagcaaagatctgaaagggaataaggatgagccatgctaatgttttgggataagggttctcatcagaagaaatggcaaatgcaaatacataaaacaaaagcattgctgggaatttggaggaaatgcaggaaagccat

SEQ ID NO: 809 - DNA, 661 bp, Homo sapiens
  BAI3
  misc_feature [331]..[331]: Chromosome 6, SNP identification no. = rs10945139
  misc_feature [331]..[331]: allele = t, in linkage disequilibrium with rs10484791, respectively
  misc_feature [331]..[331]: n is a, t, c or g
taggagaaatgcctaatgtaggttgtgggttgatgagtgcagcaaaccaccatggcacgtgtatacctatgtaacaaaactacacgttctgcacatgtaccccagaacttgaagtataattttaaaaaataggaataaacaaagagaaatataaaaagaacccaatctgaaaatctaagtaaagcaattttgtaacaaagcaggaataggcctcaaatacaataaaaaagatggaaagtgccccaggtctcctattacctatagcctgtgggtgagtggttacactatctaaaaatcactatgctccagcaatcccacttttggatacacnaccagaataattgaaagcagagttctgaggagatatttgcacatccatgttcacagcagcactattcactgtagccaagaggtagaagcaacctaaatgcccattgaccattgacagaagaataaacaaattgtggtgtatacatacaatggaatatttttcagccttaaaaatgaagtaaattctgtcataagcaacaacatggatgaagcctgaggacattatgctaagtgaaataagccagtcacaaaaatatattgtatgattccacttatatgaggtatccaaagtagtcaaatttatagcaacagaaacaatggtggttaccag

SEQ ID NO: 810 - DNA, 661 bp, Homo sapiens
  BAI3
  misc_feature [331]..[331]: Chromosome 6, SNP identification no. = rs12154008
  misc_feature [331]..[331]: allele = t, in linkage disequilibrium with rs10484791, respectively
  misc_feature [331]..[331]: n is a, t, c or g
cctttttaagttattattttcttcttattgattcacaagagccctttctataactatgtttaggaagtatctcactataaaaatgtttataatttttatataatcaaataaactggaatttgtttgaaatacatgatactacatcataattagaatcctgtttctcatatcttaatagaattcatcccattgtgacttgtgacatggctgttctctcaatgaccctttgtttttctctttgctctttctcttttaatttgttctcctttttcactctccatttctaatagggccttttcttatttatccttgagctttccctcttcccctngtccctggtctgtagtttttctcggtctctccaaaaacattcacttgatttctttagtaattttttggagtctctaatccttttaaactaacatttttttattttatttaatattgtttggagataatttgatttctacatcctctaaatatttcatttcatgttcttagtcccatagtccatttgctttcccttgtggttttttgtatttgcttagttattgggttattgtgtcttttggacagaatacatccatcataaaagcagcaggctcacagtcatcttacagcttccataagtcactaccttgttaaggcagcctgcagtagt

SEQ ID NO: 811 - DNA, 661 bp, Homo sapiens
  BAI3
  misc_feature [331]..[331]: Chromosome 6, SNP identification no. = rs7745837
  misc_feature [331]..[331]: allele = g, in linkage disequilibrium with rs10484791, respectively
  misc_feature [331]..[331]: n is a, t, c or g
gctgtgtgttttgaaacctaccattggccagtgagggtgaggtggggacagtgagggtgctggctgaggatgggtggtatgggttagtgaaagatgggcataatgtcatccagaaaagttttaaagcacataaccaaatattacagacttcagttattagcctttaattcctaaacaaccattgtctaagttacaacatgcccaacttcaggaagctagtcctcttttaggtttatttgttcctatgtatatctgggagtcccaaggagatcttaccttttttgcccatctgtcctaagcttagcctattgttccactcttctgggcttcntcttctatcccttgagtgcaggtttcctcttccaggacacttctcctccacttgtactgctgcttctgcaaatgtggatgcaggttacctggtatctctctgagaatagctaagtccaggctctactacctaacagtacttactgaaaatgtcaggcacagacaagaatgattaaactcatttctagatataactgctctcatgcttcataacacaaaactcctcactgggttcctcactgagttcttatagtttagacttctaccgtgtttcatgggccaatttatccctctcggtaagaatattcttaaccaggtcactcgcaaacag

SEQ ID NO: 812 - DNA, 661 bp, Homo sapiens
  BAI3
  misc_feature [331]..[331]: Chromosome 6, SNP identification no. = rs12201488
  misc_feature [331]..[331]: allele = t, in linkage disequilibrium with rs10484791, respectively
  misc_feature [331]..[331]: n is a, t, c or g
acatcagagatgaaagttcatggaggaagagagaactctatttaaaaattattattatgcaaatggttgtctcttagctattataatacatttacataatcaaaatcttattaaaattttccccataccaagggagcattttgccctcaaataattcaaaggcaacctgtagagaaataagaaaagctgatgtatttttaaaaatccgtatactatcctcacaccctcatctatttgtagccatcataattgtcaaaattggaatccattcagtgctaaaaaaatcctgtttcatgtctattgagaacacaaacgcaagggggcatactgnaattattttaattaataagcatatgtggttatttattgagcataaaatttgggtgtgatacaactataagccctccatctgtgtaatgtaatgtgccctgaggatgtgatatagtgatattaataactgggaactcatttttatttcctttaattttgtatcaattcatttcagttatcattagcttactattcatcccacatcaacttatgtatgatactgtgggggaaaaaaggcatttataagaaaagctttttagctttttggaaacctatgatttaattggtaaaatttaggcataaaaatttgaggtgatttgtaagcaatata

SEQ ID NO: 813 - DNA, 661 bp, Homo sapiens
  BAI3
  misc_feature [331]..[331]: Chromosome 6, SNP identification no. = rs10484791
  misc_feature [331]..[331]: allele = c, t
  misc_feature [331]..[331]: n is a, t, c or g
ctgctttcaagtacaatgcatatttgatcttcatgtttatcatgagttaggcaggatagtgttattcccctgttagattaggaaaattagacttttgttagtctctgaacactttcctttcatgccaggcctctggtcatagcaggggaattttagaaaccaagaaatcagaggggcagggagtttcaataaaggggatcaccaagtgtaactgaaaatcaaaaagaagataaacttccctctctcttgtttactatcataacatgctgtgcttgtattactacaccattaatagctctgccttttgattgtttcctctatgctggtggantctgaaaacacacattgtatattatttgtattattttcttgttttaacatagcacctgataggtggtcagtatatttgtattgaatgttcattaccaggtgttctccagcagaattggaaataagtgtgtaaaatacaaaatgtagattctgagctcagaaactcataaactaagtctagatgggactccctccatttaatatgtgcttacatgtggaagtcatgggtggagaataaggaaatttaaaaaaaaaaacagcattagaaaggttgaagatatcaacatgtatgctctcactgagaatttagagaagactgaagtctaaccct

SEQ ID NO: 814 - DNA, 661 bp, Homo sapiens
  IBTK
  misc_feature [331]..[331]: Chromosome 6, SNP identification no. = rs2323642
  misc_feature [331]..[331]: allele = a, a, in linkage disequilibrium with rs508106, rs723142, respectively
  misc_feature [331]..[331]: n is a, t, c or g
tgtgtaagtaagtggatcagacatcttaagggtcacaaatatcaacatgaggacgacgactgtcaatccacaccgttacctttcataatccctattgacccaaaaacgtaatctaacttcaaggttggtccgtttaaaatttaaattacacttttgtgattcatacataccctaaaccgatgaagagttttaatttacaaagtgaacctctttattatcttggaaagagtagtcagtagaagtcaccttcttatgaaaaagaaacaccggaccgaactacaaacttacatttaagaaagtttaaggtaaatctcgattgggtatgttatantttgttaaagttaataaattataaaatttcgattttataataaatctcattttaatgtcccgaagaaaacgactcctcgttttaagaccaattaaaaatacgtccatgtttacagattttaagaagaggtatttaaaagacaccgacaattccatcttttatcgacctcgaacactcaatccttttattttaacaccctttagtccatgacaaaggttaataccgtatcagtcacctttcttgtcattttgtattaacttctttagacaaacagttaggaatacggtcatagtgtgttagaatcaagtaaaacacgacgacattgtctca

SEQ ID NO: 815 - DNA, 661 bp, Homo sapiens
  misc_feature [331]..[331]: Chromosome 6, SNP identification no. = rs540814
  misc_feature [331]..[331]: allele = g, g, in linkage disequilibrium with rs508106, rs723142, respectively
  misc_feature [331]..[331]: n is a, t, c or g
gaagaaaaatcggagtgttaaaacgaaaaacatctggttagtttctaaagatacacacagaagtttctttataatgttctgtttgggagaggaccatgttctcgatgtcttaataaacgtatatattagagaagaacacggaggacgatcgtacccggaaaagcagaagttaggagtaccatattgttttcttatttaataccatgatgactatcttgcaatttgactgttagaagactccgtggccgtcaaattacctttggtttcttttaagttctaatatgtaaaagagtatttacataaagaaaaaggacagaagagaaagtgtatnatagttaaaagaacggaagaataataagtcaaaggatagacagtttattgtttgggtttcgacggaagctcggttagaggacagttaccttggcatgaacgactatctcctaattccataaccgtttagacaatgttccacaaatccaaatattaatttctaaatcaatttaattatttgtcgtcgttaaagttcttctgattttcctaacggaatggactataaaacggaggaaagactgatgattcccttctacacttttcacttttacttccacaaatatatcacggtagatcgctgtctatggattttttcgagacatagtaaata

SEQ ID NO: 816 - DNA, 661 bp, Homo sapiens
  misc_feature [331]..[331]: Chromosome 6, SNP identification no. = rs2753211
  misc_feature [331]..[331]: allele = c, c, in linkage disequilibrium with rs508106, rs723142, respectively
  misc_feature [331]..[331]: n is a, t, c or g
taccttcttttatatttttctaaatattgatctttatttcctttagtcaaggaaggtgtggaatgggcagaaggcagcaagataaatggtcatatggagttgggataaaataaaaaataaaccccctgggtgttgtaacatgaatggagtgtgcatattacaggtaagcgtaaatagtgttggcatctagaattgagatcttttgggacctaagattgtgttgtacatgccctagtaaaattgtaaaagaagaaattttaggcaatgataatagctaagctaagattcattgagtatttccatgtatcaggcactttctaacaagttttantgaatcttcacaatcccatcctgagggaagtactatcattattcttgttttacaggtctaaaaaaatgaggcacagcatggtaaattgttaaaaatcacaaaactagtgaggatggtgtggtacttatattcactgcactaataccccattatacctataatccacatatacctatatatgcagatgtgtacacacacatgtgcatccacacaccacacatatatatgtaagaatattctcaaataataaaactaaatctgatggaggaaatgtactcttgaaggaagtgccttgttagaaagtgggacaggaaggaagtgggtttttgt

SEQ ID NO: 817 - DNA, 661 bp, Homo sapiens
  misc_feature [331]..[331]: Chromosome 6, SNP identification no. = rs2753212
  misc_feature [331]..[331]: allele = c, c, in linkage disequilibrium with rs508106, rs723142, respectively
  misc_feature [331]..[331]: n is a, t, c or g
acatgaatggagtgtgcatattacaggtaagcgtaaatagtgttggcatctagaattgagatcttttgggacctaagattgtgttgtacatgccctagtaaaattgtaaaagaagaaattttaggcaatgataatagctaagctaagattcattgagtatttccatgtatcaggcactttctaacaagttttactgaatcttcacaatcccatcctgagggaagtactatcattattcttgttttacaggtctaaaaaaatgaggcacagcatggtaaattgttaaaaatcacaaaactagtgaggatggtgtggtacttatattcactgnactaataccccattatacctataatccacatatacctatatatgcagatgtgtacacacacatgtgcatccacacaccacacatatatatgtaagaatattctcaaataataaaactaaatctgatggaggaaatgtactcttgaaggaagtgccttgttagaaagtgggacaggaaggaagtgggtttttgtccctacaatcattgaatggcttctctttcaacaaaaaatatagttatcccttggtatgcacaggcagtcggttccaggacccttttggagaccaacatctaaggatgctcaagtctcttataggaaatggcatagta

SEQ ID NO: 818 - DNA, 661 bp, Homo sapiens
  misc_feature [331]..[331]: Chromosome 6, SNP identification no. = rs9344267
  misc_feature [331]..[331]: allele = g, g, in linkage disequilibrium with rs508106, rs723142, respectively
  misc_feature [331]..[331]: n is a, t, c or g
tttgagaggccaaggtgggtggatcacctgaggccaggagttcgaggctagcctggccaacatggcgaaatcctgtctctactaaaagtacaaaaaattagccgggcgtggtggcaggcacctgtaatcccagctacttgggaggctgaggcaggagaattgtttgaacccgcgaggccgaggctgcagtgagctgagatctcaccattgcactctagcctgggcaacaagagtgaaactctatctcaaaataataataataataaataaataaataaataaatgaaagaaagaaaagtttaatttctcaggtaactgcaggaaggagganaggagaatggagaagaaaaaaaaaaactccctgggttggttaccctatagtactaacctcaagttcttagtctagaaccttcaagaaggaaaagggtggagggaagaatccaaaggacaaaagctaagatagcccttctggaaaaaacagctctggaaggattttgggtttaagagaatccagaggtaggcattcaggtgttattctgccaagagagtttctaagttaaagaatgcctgaattcaatccaccagatgctgactttggataaagacattttcatcttttttccccctataaaataatgataatcagcagggcccggtggct

SEQ ID NO: 819 - DNA, 661 bp, Homo sapiens
  misc_feature [331]..[331]: Chromosome 6, SNP identification no. = rs62953
  misc_feature [331]..[331]: allele = a, a, in linkage disequilibrium with rs508106, rs723142, respectively
  misc_feature [331]..[331]: n is a, t, c or g
atgaaagaaagaaaagtttaatttctcaggtaactgcaggaaggaggagaggagaatggagaagaaaaaaaaaaactccctgggttggttaccctatagtactaacctcaagttcttagtctagaaccttcaagaaggaaaagggtggagggaagaatccaaaggacaaaagctaagatagcccttctggaaaaaacagctctggaaggattttgggtttaagagaatccagaggtaggcattcaggtgttattctgccaagagagtttctaagttaaagaatgcctgaattcaatccaccagatgctgactttggataaagacattttcntcttttttccccctataaaataatgataatcagcagggcccggtggctcatgtctgtaatcccagcactttgggaggctggggtgggtggatcacgaggtccagagttcatgaccagcctggccaagatggtgaaaccccacctctactgaaaaaaaaaaaatacaaaaattagccaggtgcagtggcgggtgcctgtaaccccagctactcgggaggctgaggcaggagaatcgcttgaacccggtgggtggaggttgcagtaagccaagatcacaccactgcactccagcctgggcgacagggtgagactatgtctcaaataataata

SEQ ID NO: 820 - DNA, 661 bp, Homo sapiens
  misc_feature [331]..[331]: Chromosome 6, SNP identification no. = rs529833
  misc_feature [331]..[331]: allele = g, g, in linkage disequilibrium with rs508106, rs723142, respectively
  misc_feature [331]..[331]: n is a, t, c or g
gaacactatcactcactcaagagtgcgttagactaccaaaaaatttcccgaaaaggggcaaacgaagagtgaacagagaggacggcgggacacttcttcctgcacaaacgaaggggaaagcggtactgatattcgatggactccgaaagggtcggaacgtcttgacacttagttaatttggagaaaggaaatatttaatgggttagatccataaataagtatcgtcacacccttacctgattatgttcggaactccttcttagttggaacatagaaaagagaccgaaaaccttagacaaacacggagtgaacgataccagatttacagacnggggaaggtttaagtatacgactttaggattaggagttccactgtcataatgctccattccggaaaccctccactaatataacattctcgtatagggagtgataatccttagtacgggaagaatttctggtatctctcgatcgatcggggaaggtggtacactcctgtgtacctcttccacggtagatacttagtcctttatctggagatggtctgtggatcagacggtcactctacaaccccttacctccgtcctgaaatcagtaaaactccttatattttattttatcaggttctaccgatctctccaatccctacagaattgacctt

SEQ ID NO: 821 - DNA, 661 bp, Homo sapiens
  misc_feature [331]..[331]: Chromosome 6, SNP identification no. = rs544734
  misc_feature [331]..[331]: allele = a, a, in linkage disequilibrium with rs508106, rs723142, respectively
  misc_feature [331]..[331]: n is a, t, c or g
taccgtcgtatagcgagtatgtaccgaagcacgggaggggtaccattactcacacaacaatgatataagtaagtgtcctcttgactaacaagtctctgactgtggagaagggagatagaacgagggagagaacggtacactgaacggacgaggggaaagtggaaggtggtactcattttcgaaggactctgaagtagtctacgaatcgtctacgaccgtggtacgtcttggtactcggtttatttagagaatgatttaatgactcggagggcataaggaaatatcgttatgttttgtccaattgtgtaataggatgacatgaacataccgnaatataattcttccataaatacttacctacaaagagaaaattttcttattttgtagttccgactcgtaccaccgagtgtcgatattagggacggaaaccctcgggctccgttcgttttccgaactcgggtccttaaactgtggtcggacgagttgtaccactttgggacagagatgttttttatgtatttcctcgacccgtactaccaagtacggacatcatgaaccatcatgatgttcatcgatgaaccctccgactccaccctcctagtgaactcgggtcttccacttcgaacgtcactcgcctctagtacggtaagtgaggtcggtc

SEQ ID NO: 822 - DNA, 661 bp, Homo sapiens
  misc_feature [331]..[331]: Chromosome 6, SNP identification no. = rs554594
  misc_feature [331]..[331]: allele = a, a, in linkage disequilibrium with rs508106, rs723142, respectively
  misc_feature [331]..[331]: n is a, t, c or g
ggatggatggatggattgatggatgaatggatagatagattataccaaccctataaacagaggagttttagagtactactttacactagaggttacaacctccaccttgaatcaccctccacaaacccagtaccgtcgtatagcgagtatgtaccgaagcacgggaggggtaccattactcacacaacaatgatataagtaagtgtcctcttgactaacaagtctctgactgtggagaagggagatagaacgagggagagaacggtacactgaacggacgaggggaaagtggaaggtggtactcattttcgaaggactctgaagtagtctncgaatcgtctacgaccgtggtacgtcttggtactcggtttatttagagaatgatttaatgactcggagggcataaggaaatatcgttatgttttgtccaattgtgtaataggatgacatgaacataccgaaatataattcttccataaatacttacctacaaagagaaaattttcttattttgtagttccgactcgtaccaccgagtgtcgatattagggacggaaaccctcgggctccgttcgttttccgaactcgggtccttaaactgtggtcggacgagttgtaccactttgggacagagatgttttttatgtatttcctcgacccg

SEQ ID NO: 823 - DNA, 661 bp, Homo sapiens
  misc_feature [331]..[331]: Chromosome 6, SNP identification no. = rs511002
  misc_feature [331]..[331]: allele = c, c, in linkage disequilibrium with rs508106, rs723142, respectively
  misc_feature [331]..[331]: n is a, t, c or g
cgattcaaatttagagggtgtaataaacttactactcaagttcatatcttcgacgagaccgaaccttcttagaaagtacttgacgtctgaacacccacgtaggatcgtgtcccatcgtaacgtatctttcccggacgttggaagaccgaaacgtaggtaacttcacacttaaagatttttagtaccgttcgtccagggagaccactggatcgagggtcatttcttaacagaatcatcttttctgtgattttcatttaccctttaacacttgtgttataaagaaaggggaagaggtactaaaggattcgtttacttgttgaacgaaccactncggaaaggacagacgagtttgaagaagagataaaaagaaatattataaatatgaataaatcaaataatagatataggtgaagagatcttgtattcaaggtacttcagtagctaaagaaagtgacgaatcggggtacgggtcttttcaaagaccgtgaatcatccacgagtaatttatgaacaaaatttttttttactcatttgaattcaataacgaaagggtgtattgaatatttccttattagtcagataaaattcatcaaaatcctaacacaggggtttttacttttattttatgattctctctacttggttccacctaataaataga

SEQ ID NO: 824 - DNA, 661 bp, Homo sapiens
  misc_feature [331]..[331]: Chromosome 6, SNP identification no. = rs507500
  misc_feature [331]..[331]: allele = c, c, in linkage disequilibrium with rs508106, rs723142, respectively
  misc_feature [331]..[331]: n is a, t, c or g
acagtcacaagtttcccttacgaaggtcaaaaacgggtaagtcatactataaccgacacccaaacagtatttatcgacaataataaaactctatacagggtagccccttttgtgtaagaaatagtcgtaaagtatcacactaaaacgtgaagataacactatagagacatccacaaaactgttacaacggaaaaatcgtgtttgtttgtacatacgttctatctttctcttcgttttcagagtacgtcacagaggttgaagtctgtacaaattctagttcggagtccgttaggttgaaaagaaaactgttcggtttacaggacacactttnctatgacttgacgagttcctcaaaccgattcaaatttagagggtgtaataaacttactactcaagttcatatcttcgacgagaccgaaccttcttagaaagtacttgacgtctgaacacccacgtaggatcgtgtcccatcgtaacgtatctttcccggacgttggaagaccgaaacgtaggtaacttcacacttaaagatttttagtaccgttcgtccagggagaccactggatcgagggtcatttcttaacagaatcatcttttctgtgattttcatttaccctttaacacttgtgttataaagaaaggggaagaggtactaaaggat

SEQ ID NO: 825 - DNA, 661 bp, Homo sapiens
  misc_feature [331]..[331]: Chromosome 6, SNP identification no. = rs532219
  misc_feature [331]..[331]: allele = a, a, in linkage disequilibrium with rs508106, rs723142, respectively
  misc_feature [331]..[331]: n is a, t, c or g
gaaaactctgtgagacagctgaaaaagtgagttcccaaagcatgagagggaaaaacctgcctccaaacacacatctccagtggggaacctgaaaattcacataataggggaaggatataatagacttagggagccaagcaaaatattaaagtagaagaagcaatagaaagagccttgtaggcactctcacttcccagcttgagcccagggaagccacccctgactttatctcacagggctccttaaggaaggcagccagtggaactagggaggggtcacagggtgaaagaagcttccaactgaactttgtaataatttcaaccaagctcanattttcttgagccgaatccaagggttaaacaggaaatgctgcagatacaagcactggagctgcagccaacagtgtgtgcagacagggagaggcaagacctgaaagcgatgatagctttcttagctggaaggcttcttgcctggggcaaggtctgagccctgtgcatgggctacctgaaaataaattgttggtgaggcatgacaggagcaagaccagccttgatggctgtgtgggagctgggtgagacctgtcactgttggcttcccccaacttccctggtgacctgtatgatgcagcagaggcagccataatccctttagaacataactc

SEQ ID NO: 826 - DNA, 661 bp, Homo sapiens
  misc_feature [331]..[331]: Chromosome 6, SNP identification no. = rs577767
  misc_feature [331]..[331]: allele = c, c, in linkage disequilibrium with rs508106, rs723142, respectively
  misc_feature [331]..[331]: n is a, t, c or g
agacgatagtcgacataaaaaaggtacgagaaaagatgaaaacacctctagttgaggaaacaataagagggttttacaaatttatctgacctcgacatcaaactttttgttactctttacgatctcggaatattttgcaatttgtcgatgttcttgtacagattaagaaacttatgataaagtaaaatcttacattgtacttctcctcttctcgaacttgaccctcaattctggaataaaaatcgggactaagacggtgtttgaataatatattggaaacccgtgaagagtctcggacataaaggagtacacactttacttccgtaatccnatcttactagaagggagggacggacttgtaaagtattacgatgtaaagatgtaaagagttcaaattggaagtaagatgtgacttatatggattttaaaatacatctaggagagaactttttaataaagcgacggtgattgtgacaaaacgtttaacaccagaagtttgaaggaaaattgtcttggtggaccttaaatataatttttacgtctaagatcctggacgggtgcgtatttctaggttttagaaatacttctctccctcctaagttcttatatacatatatacacacacacacatatatatatgtgtatatacatatatatatta

SEQ ID NO: 827 - DNA, 661 bp, Homo sapiens
  misc_feature [331]..[331]: Chromosome 6, SNP identification no. = rs526833
  misc_feature [331]..[331]: allele = t, t, in linkage disequilibrium with rs508106, rs723142, respectively
  misc_feature [331]..[331]: n is a, t, c or g
aaaggagttgatctccacaaaagtagaaaagagcatggaaaaaatacagctgatagcagacaaggttttctctgtgaaaagattttaaacaattattttatgttttaaatacctgtaattaaacccctttctgtaaccactccagtctccttttggcttttccaaaataaaatcttttttctgcacaggaaggtcagattgtgtcttgttgattcacacctgatgagcaaagtgcatgtatcatgaatgctaacacccattgttattattttcaagaaccaggtattaagtgcctacgatgccaacatggaaaaacaaccctttgacaganttttcttcatttttgttaaactcttctgcatttctataggataaaaatctatttcaaagctgtgctgctggcagttttacatgaaatgtattttaaacatgacagttgttttcatgtggaaaaatacaaacatggctaacatataaaatgattatacaaattgcgcaggactgattgcttagaatattcactattccaaacgttctgtttcttaaagggaaatattcatcagaaaataaattgcatatttagaacttgaaatccgactttttttataaaaagaaataagtttctacttcttcacaaagaagacagtgaacatattggagt

SEQ ID NO: 828 - DNA, 661 bp, Homo sapiens
  misc_feature [331]..[331]: Chromosome 6, SNP identification no. = rs7756828
  misc_feature [331]..[331]: allele = a, a, in linkage disequilibrium with rs508106, rs723142, respectively
  misc_feature [331]..[331]: n is a, t, c or g
acttttgcaagcacagcattacataaagcatttcagtaatgttattcagtttgcttccccagggtcttgaaaccagctcataggtgctgacttgttccaacctcaaaatcttcattctaggcagaaattaaaccaagtcaaaggagacagacatactcagagaaggggaaaatatctagagataaacgattatgatactctctctgatagcccatcaattccttatatacaaatcttaggtgattctgatacccaactaggtttggaaccaaagttgtagatggtctaatacagtaattctcaatctctgatgcatattaaaatcaagagnagaatttatttaaaaaatagaagcttcacacacccagatattttattgacttgagcatcagaatttgttttaaaagtctccagttattgtattaataatgtgcagccaggatcgagaacaactgatctaaggtattaaataaggaagagttattcccttctggaggagaggggctcagtttccttaattctttattcattgaggaaactgagctcctttcctccagaagggaataattaaatttctgtaagcatgcataaatatgaatagtcaattcaattcaacaaatctttattgaggacctacatgtttgtggtattcatgcctatt

SEQ ID NO: 829 - DNA, 661 bp, Homo sapiens
  misc_feature [331]..[331]: Chromosome 6, SNP identification no. = rs508106
  misc_feature [331]..[331]: allele = t, in linkage disequilibrium with rs723142, respectively
  misc_feature [331]..[331]: n is a, t, c or g
gagttcattaaaaagtcctgaaaacgttatcactcatgttaagacattaaactttgtttgtgttcaattttctttaggttctaatgagaataaaaaacgttataaggaaagttttgtgaaaatatcaaaatcacaggtagtactcgtcagaactgtcaaaaaaccatgtgtcccgttgaaaacttcgtactccatcttaacgtcatagtacagtatcataatagaagtcaagatgtctaagtcttcagttgtaaaagactaaaattttggtctaatatgtgatataaggactatttctggagttcgatagagagtcgagaaccttcatggntttgtggaacgaaaagaaggacaccgtaaatggaataagacggaacttattaaagaaaaaaaaaaaaaaaactctgtctcagagtgagataacgaatccgacctcccgtcaccgtgttaaagtcgagtgacgttggaggtggacgacccaagttcactgagagtatggagtcggagggttcatcgaccctggtgtccacgtacggtggtccgggccgattaaaaacataaaaaccacctctgctctaaagtagtatacacggtctgaccagaacttgaggactggagttcactaggcggacggagtcagagggtttcacgaccctaatgt

SEQ ID NO: 830 - DNA, 661 bp, Homo sapiens
  misc_feature [331]..[331]: Chromosome 6, SNP identification no. = rs555844
  misc_feature [331]..[331]: allele = t, t, in linkage disequilibrium with rs508106, rs723142, respectively
  misc_feature [331]..[331]: n is a, t, c or g
tggacattgcctattgatttctactctaaaggattggatgttgcctattgcttttctactctaaaggatgaagattttgctcagctctacagtctgcctcttcctgcaataaatgttgtagagactggggatatacccgtgaacagaacaaagtccccagtacttatgaacttacattgcggtttgagaaggtaaaataactaaataacataaataactaaataactgaattatataattccagaaagtgaaccataatatgaaaaaaaggaaagaaaaaaagacaatgggaaaggacacaagtctctttcctccctctacccaatatagntgtaataaaacgtttgatgttttcaccgatatgactagataactacttgacactgaagcatatatcgtactataattaccattcatttattgtacaactatttcttttctctgagactgtaattttatttgcatttgatttgttttccatgtactgagaactaattcattcctatcattctgccaaaactataaaacttctcttgatgtggtcaaacacaacagttaattctgttttttttttctccttctccttttcttcctctctcatcattcctcccagatacctctgtcctcctgctccagccttttccagtaactttccaggcct

SEQ ID NO: 831 - DNA, 661 bp, Homo sapiens
  misc_feature [331]..[331]: Chromosome 6, SNP identification no. = rs1923137
  misc_feature [331]..[331]: allele = a, a, in linkage disequilibrium with rs508106, rs723142, respectively
  misc_feature [331]..[331]: n is a, t, c or g
ccagtgcaagtggagggcctatgcttcattcgcttcatggtaaaactgactcttcatcctgattcctaccagggtcccagaggagtggtatctgactttgttggctgaagaggagatctgggagttctatactgctgcttacagtcttctcatcaattctcttctttttagtgctatcccataccctggttcttcacgaggaaccagtgtcttcaagtcccaaagctttatggcccttaaagtttaatgggagtgcttctgttggggcatctgacactgcaggcagttaggcttcagtgatctctgctgagctgtcttttatcactcattnattatttcccaccatctaaaatgtgtggctatctcttagctgctgttattccccaccctgttctctttgttctcacagtggttttattcctttgctgccatttaagtgggggttttaggagagcacagaactaaacaaacaggttcagtttgccatgtttaatcagaagtctcattctatctttgaatatttttatgtttgtcattaaatccaatattttattgccacttagatgaatttattatacaactcagcatttgttgtactacatatttaagaaatatatactgtacttcaatattctcataaactgttgttttttgttctttt

SEQ ID NO: 832 - DNA, 661 bp, Homo sapiens
  misc_feature [331]..[331]: Chromosome 6, SNP identification no. = rs1923138
  misc_feature [331]..[331]: allele = c, c, in linkage disequilibrium with rs508106, rs723142, respectively
  misc_feature [331]..[331]: n is a, t, c or g
gagggcctatgcttcattcgcttcatggtaaaactgactcttcatcctgattcctaccagggtcccagaggagtggtatctgactttgttggctgaagaggagatctgggagttctatactgctgcttacagtcttctcatcaattctcttctttttagtgctatcccataccctggttcttcacgaggaaccagtgtcttcaagtcccaaagctttatggcccttaaagtttaatgggagtgcttctgttggggcatctgacactgcaggcagttaggcttcagtgatctctgctgagctgtcttttatcactcattaattatttcccancatctaaaatgtgtggctatctcttagctgctgttattccccaccctgttctctttgttctcacagtggttttattcctttgctgccatttaagtgggggttttaggagagcacagaactaaacaaacaggttcagtttgccatgtttaatcagaagtctcattctatctttgaatatttttatgtttgtcattaaatccaatattttattgccacttagatgaatttattatacaactcagcatttgttgtactacatatttaagaaatatatactgtacttcaatattctcataaactgttgttttttgttcttttgtttttaatatc

SEQ ID NO: 833 - DNA, 661 bp, Homo sapiens
  misc_feature [331]..[331]: Chromosome 6, SNP identification no. = rs723142
  misc_feature [331]..[331]: allele = t, in linkage disequilibrium with rs508106, respectively
  misc_feature [331]..[331]: n is a, t, c or g
taaaggagcttgtaaaaaaaattccctatgttttgtggaaaaaaattttgcctagtttattcttctagataatgtttgataatgtttgttaaatatataaatgtgccaagaaatagtcctatttcatccactatgcttcttggaaccgcagatttgcaagaaaacttcaataagtacagtgtaaaaaagagatatgtagtcaagtaagttttctaaactctgagttcaatgaaatcaaacagttttttttacatcaagacttcttagagccttaactacaatattcacagtgagtctttaaagagggaataattattagtattttccaaanttattgtactaccagtcctatttaagcagcacactattaactccttacaaaacaaattacatcaagatatagtttgaaaatttttttaatcaacagcatgttttctaattctgttgaaagacctaattttcatcctatgaaagacctaattttaatcctgaagggtaattgtagttcttccattatcaattccattctagatcctgatctcttatgcttactctcacttgaaacccttaggaatatcagtttgaccatcttccttgaggatgtaaataatacaggaggaaatgaaaagctcatgtcagagaaattttaatattagagtta

SEQ ID NO: 834 - DNA, 661 bp, Homo sapiens
  misc_feature [331]..[331]: Chromosome 6, SNP identification no. = rs2180742
  misc_feature [331]..[331]: allele = c, c, in linkage disequilibrium with rs508106, rs723142, respectively
  misc_feature [331]..[331]: n is a, t, c or g
tcaatgaaatcaaacagttttttttacatcaagacttcttagagccttaactacaatattcacagtgagtctttaaagagggaataattattagtattttccaaatttattgtactaccagtcctatttaagcagcacactattaactccttacaaaacaaattacatcaagatatagtttgaaaatttttttaatcaacagcatgttttctaattctgttgaaagacctaattttcatcctatgaaagacctaattttaatcctgaagggtaattgtagttcttccattatcaattccattctagatcctgatctcttatgcttactctnacttgaaacccttaggaatatcagtttgaccatcttccttgaggatgtaaataatacaggaggaaatgaaaagctcatgtcagagaaattttaatattagagttattggggagaagcagggatgaataaaggataacagtgggatggtgaggcaaaagctaggtcaccccaaatagtcctgagctgaagagcttgcttataccttaggatcagggttaattttaaggcagaatcagatagataaagaggtaacaccaaagatagtcattaagtctctctcctccctctgttctctctctaatctttagtgtttgccaaactttctctctg

SEQ ID NO: 835 - DNA, 661 bp, Homo sapiens
  misc_feature [331]..[331]: Chromosome 6, SNP identification no. = rs1547614
  misc_feature [331]..[331]: allele = a, a, in linkage disequilibrium with rs508106, rs723142, respectively
  misc_feature [331]..[331]: n is a, t, c or g
gagggaataattattagtattttccaaatttattgtactaccagtcctatttaagcagcacactattaactccttacaaaacaaattacatcaagatatagtttgaaaatttttttaatcaacagcatgttttctaattctgttgaaagacctaattttcatcctatgaaagacctaattttaatcctgaagggtaattgtagttcttccattatcaattccattctagatcctgatctcttatgcttactctcacttgaaacccttaggaatatcagtttgaccatcttccttgaggatgtaaataatacaggaggaaatgaaaagctcntgtcagagaaattttaatattagagttattggggagaagcagggatgaataaaggataacagtgggatggtgaggcaaaagctaggtcaccccaaatagtcctgagctgaagagcttgcttataccttaggatcagggttaattttaaggcagaatcagatagataaagaggtaacaccaaagatagtcattaagtctctctcctccctctgttctctctctaatctttagtgtttgccaaactttctctctgcacatattaaacattcagattttgtggccaaggcctcagactgatggaagcagagtatgcggaaaagatgattctta

SEQ ID NO: 836 - DNA, 661 bp, Homo sapiens
  misc_feature [331]..[331]: Chromosome 6, SNP identification no. = rs2145368
  misc_feature [331]..[331]: allele = c, c, in linkage disequilibrium with rs508106, rs723142, respectively
  misc_feature [331]..[331]: n is a, t, c or g
tgaactcaacttctgtcatatgtgtttgcttagctttggattctggtcacacagtttctgagcccattatctcatcttggttctggtttttctctctctacttaatatttcagattggcattaaaccgagtgaattccctttctgattaatcttgccagagcagcccagaaaaaaatgatctcaataccttctcctaatatttgagggaattggatgttaaatagattcacagtaactgaagaatagttgtggaagggaatttttaaaaatagttaacacagaattcaaaaagtacaaaaaaagcaataactaagaagtataattcttctntcctgtttctgccagctacaaagttctcctgcatgaaggccactggcattttatgaattgttctggagatactctaatgagtttacaaacatttgtgtaatatttgtgtgtatatttcttttacacaaacgtatcatgccatctactctgctctgcatgttgttgttgttttacataatttatcttagagattgttatagattgaattgtatccccccaaaaagtatcttggagtcctaacctctaatacctcagaaagtgaccttattggaaataagtttgttgcaaatgtaattagttaagatgaggtcatactggagtaggacgggc

SEQ ID NO: 837 - DNA, 661 bp, Homo sapiens
  misc_feature [331]..[331]: Chromosome 6, SNP identification no. = rs2180743
  misc_feature [331]..[331]: allele = c, c, in linkage disequilibrium with rs508106, rs723142, respectively
  misc_feature [331]..[331]: n is a, t, c or g
taaatagattcacagtaactgaagaatagttgtggaagggaatttttaaaaatagttaacacagaattcaaaaagtacaaaaaaagcaataactaagaagtataattcttctctcctgtttctgccagctacaaagttctcctgcatgaaggccactggcattttatgaattgttctggagatactctaatgagtttacaaacatttgtgtaatatttgtgtgtatatttcttttacacaaacgtatcatgccatctactctgctctgcatgttgttgttgttttacataatttatcttagagattgttatagattgaattgtatcccccnaaaaagtatcttggagtcctaacctctaatacctcagaaagtgaccttattggaaataagtttgttgcaaatgtaattagttaagatgaggtcatactggagtaggacgggccttcagtccaatgtgactagtgtccttataagaagagacagagacatagaggaggaatgccatgtaacaacagaggtggagattggagtcatgcaactgcaggccaaggaaccccaaggcttgctggcaaattaccagaagctaggaagaggcaaggaaggattctcacctacaggtttcagagggagcatggcactaccaacaccgtgatttgggac

SEQ ID NO: 838 - DNA, 661 bp, Homo sapiens
  misc_feature [331]..[331]: Chromosome 6, SNP identification no. = rs7762072
  misc_feature [331]..[331]: allele = a, a, in linkage disequilibrium with rs508106, rs723142, respectively
  misc_feature [331]..[331]: n is a, t, c or g
accttattggaaataagtttgttgcaaatgtaattagttaagatgaggtcatactggagtaggacgggccttcagtccaatgtgactagtgtccttataagaagagacagagacatagaggaggaatgccatgtaacaacagaggtggagattggagtcatgcaactgcaggccaaggaaccccaaggcttgctggcaaattaccagaagctaggaagaggcaaggaaggattctcacctacaggtttcagagggagcatggcactaccaacaccgtgatttgggacttctgttacagtaggtagctagtcaggcatgagaagggcagganagggccccccaccaccatgaatgtcagacaaccatcaggtgatgatcaggcagttgttaactgtctctctaaaataataattggttacagccagtgccagggaaaggcagtctccttatgcatagaaaaaacctgaaactggtgatcagcagcttcctggtatgtatcaggagtcgggcaagtaggttcaagcatgcacattaagaggcaaaatggcgaagtttaactggtatatgaccttccagggacatgccaccagtaagggaagaatgcctcaaatgagcatgttcacctcccgactgctagcagaccactgtgcatgaggacagc

SEQ ID NO: 839 - DNA, 661 bp, Homo sapiens
  misc_feature [331]..[331]: Chromosome 6, SNP identification no. = rs13191698
  misc_feature [331]..[331]: allele = g, g, in linkage disequilibrium with rs508106, rs723142, respectively
  misc_feature [331]..[331]: n is a, t, c or g
cagccttaggaagtgaatacagagatctttccatattaatagagaagtgtttcattctatttgacagctgcacagtactctattgtatggttgggccataacttatctactggataaaataagttatggacatttatgtgatttttaaacttttgtcattaaaaacaatgcagaaagtgagcaaatttgtacatgtgtcaattcacatgagtgagactatcttgagctaaatacctaggggtagtgaataatcaaattgaaataagatgctttgcatgtgaacaagtgaagaattattgagacttgagtaaccctaagtttccacagaggntatagtaaaattgtgtgccagccaataattatgctaagtaggatgactttgtcttgtctcctctcccatccctccccaaaattgtttgccggctatgtaaccttttagataagcctctgttctctccggatctctgctgcagttgaatttctaatgttctattacctaacatcttagggtggttataaggatcaaatttttaaaaagtttgtgaaagcaatttccctacataaagacagggatttgctattgtctttggtgtaaagcaatgtttgataactttattatgcctttcatccacatcctatccacaaacacttgttctgggtt

SEQ ID NO: 840 - DNA, 661 bp, Homo sapiens
  misc_feature [331]..[331]: Chromosome 6, SNP identification no. = rs13207433
  misc_feature [331]..[331]: allele = t, t, in linkage disequilibrium with rs508106, rs723142, respectively
  misc_feature [331]..[331]: n is a, t, c or g
ccatattaatagagaagtgtttcattctatttgacagctgcacagtactctattgtatggttgggccataacttatctactggataaaataagttatggacatttatgtgatttttaaacttttgtcattaaaaacaatgcagaaagtgagcaaatttgtacatgtgtcaattcacatgagtgagactatcttgagctaaatacctaggggtagtgaataatcaaattgaaataagatgctttgcatgtgaacaagtgaagaattattgagacttgagtaaccctaagtttccacagagggtatagtaaaattgtgtgccagccaataatnatgctaagtaggatgactttgtcttgtctcctctcccatccctccccaaaattgtttgccggctatgtaaccttttagataagcctctgttctctccggatctctgctgcagttgaatttctaatgttctattacctaacatcttagggtggttataaggatcaaatttttaaaaagtttgtgaaagcaatttccctacataaagacagggatttgctattgtctttggtgtaaagcaatgtttgataactttattatgcctttcatccacatcctatccacaaacacttgttctgggttatagacctgcttctcatatttatgtttact

SEQ ID NO: 841 - DNA, 661 bp, Homo sapiens
  misc_feature [331]..[331]: Chromosome 6, SNP identification no. = rs1321622
  misc_feature [331]..[331]: allele = t, t, in linkage disequilibrium with rs508106, rs723142, respectively
  misc_feature [331]..[331]: n is a, t, c or g
taatcaaattgaaataagatgctttgcatgtgaacaagtgaagaattattgagacttgagtaaccctaagtttccacagagggtatagtaaaattgtgtgccagccaataattatgctaagtaggatgactttgtcttgtctcctctcccatccctccccaaaattgtttgccggctatgtaaccttttagataagcctctgttctctccggatctctgctgcagttgaatttctaatgttctattacctaacatcttagggtggttataaggatcaaatttttaaaaagtttgtgaaagcaatttccctacataaagacagggatttgcnattgtctttggtgtaaagcaatgtttgataactttattatgcctttcatccacatcctatccacaaacacttgttctgggttatagacctgcttctcatatttatgtttactatgtttcactacatagtaatttattagtcttctcctttatatttgcccacaacagtatagtatctttcctacaaatgatacaacctaataaatatttattcagtgttgttttagactaaatgtttcatcagtgaaatttttttatttcctaaaatggcctgagcatttactttagagtacagtttccatgaaccactttttccctctttcttctcttt

SEQ ID NO: 842 - DNA, 661 bp, Homo sapiens
  misc_feature [331]..[331]: Chromosome 6, SNP identification no. = rs9353066
  misc_feature [331]..[331]: allele = a, a, in linkage disequilibrium with rs508106, rs723142, respectively
  misc_feature [331]..[331]: n is a, t, c or g
cacaaatgtaaatagcctgaagggatttcataatcaaccattttcagtcatcagcaactctgtgtgaattggcccattagattcttttcctgctgacaacggatggccaggaagaaagtgtgaattcaacagagaagtttcacagaaatgagctgtgctcagcctttgccataagagggcaaagtaagtccagtgacatgcatttcactcagtcttcttctctttctactgactgagcccggagcctttgagggaggaagtccagggattggaggggtatagagattgagctaaaaggaccttcttcattggcctgcaggctcaactcttnggcaaaatcgtgaagaagtagctgttacatttttctaaactttcagtttgacaagcataaggattaatttggcaaagctcaaaatgatatctggcagtcaaaatggttcatcacacctctttaaaacataatgttgggagtggctgttttctgaaccaagttacttactgaaagtattctgtactttccagccattttccctttttctcatttctgtggccattgtggggctgctgatctccatgtactctggtaggggctacttttttttaaaaggaatctttctttttttttttttattgagataaaatatacatacacaatttacta

SEQ ID NO: 843 - DNA, 661 bp, Homo sapiens
  misc_feature [331]..[331]: Chromosome 6, SNP identification no. = rs6907015
  misc_feature [331]..[331]: allele = a, a, in linkage disequilibrium with rs508106, rs723142, respectively
  misc_feature [331]..[331]: n is a, t, c or g
attggcccattagattcttttcctgctgacaacggatggccaggaagaaagtgtgaattcaacagagaagtttcacagaaatgagctgtgctcagcctttgccataagagggcaaagtaagtccagtgacatgcatttcactcagtcttcttctctttctactgactgagcccggagcctttgagggaggaagtccagggattggaggggtatagagattgagctaaaaggaccttcttcattggcctgcaggctcaactcttaggcaaaatcgtgaagaagtagctgttacatttttctaaactttcagtttgacaagcataaggattantttggcaaagctcaaaatgatatctggcagtcaaaatggttcatcacacctctttaaaacataatgttgggagtggctgttttctgaaccaagttacttactgaaagtattctgtactttccagccattttccctttttctcatttctgtggccattgtggggctgctgatctccatgtactctggtaggggctacttttttttaaaaggaatctttctttttttttttttattgagataaaatatacatacacaatttactatttttacttttctttctttcttttttttttttttttagacagagtttcgctcttgtcgccctggctg

SEQ ID NO: 844 - DNA, 661 bp, Homo sapiens
  misc_feature [331]..[331]: Chromosome 6, SNP identification no. = rs6930014
  misc_feature [331]..[331]: allele = t, t, in linkage disequilibrium with rs508106, rs723142, respectively
  misc_feature [331]..[331]: n is a, t, c or g
tgctgacaacggatggccaggaagaaagtgtgaattcaacagagaagtttcacagaaatgagctgtgctcagcctttgccataagagggcaaagtaagtccagtgacatgcatttcactcagtcttcttctctttctactgactgagcccggagcctttgagggaggaagtccagggattggaggggtatagagattgagctaaaaggaccttcttcattggcctgcaggctcaactcttaggcaaaatcgtgaagaagtagctgttacatttttctaaactttcagtttgacaagcataaggattaatttggcaaagctcaaaatgatanctggcagtcaaaatggttcatcacacctctttaaaacataatgttgggagtggctgttttctgaaccaagttacttactgaaagtattctgtactttccagccattttccctttttctcatttctgtggccattgtggggctgctgatctccatgtactctggtaggggctacttttttttaaaaggaatctttctttttttttttttattgagataaaatatacatacacaatttactatttttacttttctttctttcttttttttttttttttagacagagtttcgctcttgtcgccctggctggagtgtgcagtggcgggatctcg

SEQ ID NO: 845 - DNA, 661 bp, Homo sapiens
  misc_feature [331]..[331]: Chromosome 6, SNP identification no. = rs9353067
  misc_feature [331]..[331]: allele = c, c, in linkage disequilibrium with rs508106, rs723142, respectively
  misc_feature [331]..[331]: n is a, t, c or g
tgtttcaatccaaatattactctgttattgatttattgaacttgtcatattatctcgttgtgaaatttttcctttacgaaaaaattttctctaaataaagaagcctcctttttcaataacagtattatttttattaagttactgactccttcttctctgcctaaaaaacatgttcaagcctctctctaccacatatatatctttccttggacactgttttctactcaagtgaatgctttatgtctttgcttcctttcctcatagactccacgtcctaacctatcattttctcatcaatcaactataataataccattatatgtaataggcnatatttgttgagtgaataatgtgtaccaggcactgtgcagcttacattttttccaggaatcaaataaagtaggtatcattagtagctttgtttatacagatgaaaacgctgaggcttaaacagtatgagtagtttgctcagcaagtcagtgagtaggtggcaaccacagaaactccagttttgtcctataggtgacatctaagtcattgccattatccacaatgtatctaccaacttactgtaactcaatcactgaatcttgaaatacaaggatctatctctactcttcatcatattcaatctcccagcttcagtcacaattgggcatct

SEQ ID NO: 846 - DNA, 661 bp, Homo sapiens
  misc_feature [331]..[331]: Chromosome 6, SNP identification no. = rs9353068
  misc_feature [331]..[331]: allele = t, t, in linkage disequilibrium with rs508106, rs723142, respectively
  misc_feature [331]..[331]: n is a, t, c or g
tgttgagttagcctcttaaattgtctcttaaatgttggtatgatctaaatttcttttgccctctgaatgtcttctctgagtgatttcagtgactcctatggcctctacaatgatctcaactctaattccaggatccctttctcctgagctccagatttatctctacttttataggtaccacaacctagaaatatccaaatcaacctcattatctttcattcgaagtctatttctctgcatttcctccctcattctacaatatattttatataaacatacaagctaatagatggagtaagagacgttttttatgtcccttttcctttcattnccacatttaatcagtcatcatgtcttacgttttcttttcttttttttttttttgagacagagtttcgcttttgtagcccaggctggagtgcagtagtgtgatcttggctcactgcaacctctgcctcccaggttcaagcaattctcctgcctcagcttcagaagtagctgggactacaggcatgtgccaccacatatggctagttttgtatttttagtagaaacggggttttgtcatgttggccaggctggtctcgaactcctgacctcaggtgatacacccaccttggcctcccaaagtgctgggattaagttgtgagccaccgtgccc

SEQ ID NO: 847 - DNA, 661 bp, Homo sapiens
  misc_feature [331]..[331]: Chromosome 6, SNP identification no. = rs2024996
  misc_feature [331]..[331]: allele = a, a, in linkage disequilibrium with rs508106, rs723142, respectively
  misc_feature [331]..[331]: n is a, t, c or g
aacagcaaccctctgagaagctgtgtggagcatccctcaagtcatcctttcttggatgatggggaggctggggcatttatccacttaccttccttccccattggttgatgggtgtccctggtggcatgaacccctctcacttcagggttgcatttgtttttgacagagcaaaccccatggtgttggagaatcaggagaagaagagagaggctggtctagaggtgcagagctttcagcaaactgcttaccacacctaaagtgaattcaggtgggccccgcaggtatggggtgtggtgttgacagggtctgctacacttggcaagggttaagnttagaattagagtcaggattagtaaactctgataggttgaagtaaacaaagaaaaaagagcatcagcatcaacctctcccactctttcctcaggatatattgagaaccacattttggcaaagtgtgtataaactattaataaagtatcatttatttcatagtttttgataaaatatgtaaattgaaactctaatattttctttccacacctggaaggtcattttgaatatctcttgggagcctgcatctcttccttatgatcagtttcctagcacagcgactcaagggcctgatgcgtcaggctgctgagatatctatctgttccgacaa

SEQ ID NO: 848 - DNA, 661 bp, Homo sapiens
  misc_feature [331]..[331]: Chromosome 6, SNP identification no. = rs12527551
  misc_feature [331]..[331]: allele = a, a, in linkage disequilibrium with rs508106, rs723142, respectively
  misc_feature [331]..[331]: n is a, t, c or g
taaaagagagggagaaagaaaggccatgacatgtgtctgcaagttgatctatagagcaagatcaattattgcatcatagatgtttgtaattgtggtgaagccaaaattttctctaaacacatttttggcatcatccacaatcctatattttaatttaggtaaatgaatttcagtaatttgatattgaaaggacattgattaggtaactcctatatgctaagccactgtaaaaagtggtatggcttatttcaaaataagtaaaacttggtctcttacttacaatctagcaggagaaatgcatgctgcatataagtaactgtaaaacaaggtngtcagaactaagatctgtaagaaaaataccatagactgtgaaaattctaagaaattatttctgcaacaagtaatttattatttcatatggtactagataaacttaacccaaattccatggcctagcaatttccttaaacctagtctatttgggagtctaccaagctgacatttagtaataagcagatttgggtttagaaaagacaaagagatctgagataggcctttacctcagtgtcaactatactgggccctaaaaaggtctttgagagacaaaaccaagtacttctttaatgtcctgtggcctagttttaagccataaattttttct

SEQ ID NO: 849 - DNA, 661 bp, Homo sapiens
  misc_feature [331]..[331]: Chromosome 6, SNP identification no. = rs9344270
  misc_feature [331]..[331]: allele = a, a, in linkage disequilibrium with rs508106, rs723142, respectively
  misc_feature [331]..[331]: n is a, t, c or g
ctgtcacccaggctggagtgcagtggcatgatctcagctcactgcaacctccacctcctgagttcaagcaattctcctgtctcagcctccccggaagctgggactataggtgcgcaccaccatgcccggctaattttgatatttttagtagagacaagatttctccgtgttggctgggctggtctcgaactcctgacctcaggtgatccaccttccttggcctaccaaagttctgggattacaggcatgagccactgtgcctggccttaagccataaactttttaaaatacaaaagcaaacactgaaacaaaaattatgcaatatttgtantgacaatgtatcgcagttttcttgagcatgcaaatattttctcaataaagacttaatcataaaatagaacctatgtgttgcatcttttgtttctttgtttcttttctttctttctttttttttttttgacagagtcttgctctgttgttgcccaggctggagtgcaatggggcaatcttggctcactgcaaactctgcctcccaggttcaagcgattctcatgcctcagcctcctgagtagctgggattacaggtgtgtacaaccacgcccagctaagttttgtatttttagtggagatggggttttgccatgttggccaggctggtctt

SEQ ID NO: 850 - DNA, 661 bp, Homo sapiens
  misc_feature [331]..[331]: Chromosome 6, SNP identification no. = rs796398
  misc_feature [331]..[331]: allele = t, t, in linkage disequilibrium with rs508106, rs723142, respectively
  misc_feature [331]..[331]: n is a, t, c or g
cactgcagactccgcctcccaggttcaagcaattgtcctgcctcagcctcctgagtagctggaactacagatgtgagccaccacacccagctaatttttgtatttttagtagagacggggtttcaccatgttggccaggctggtcttgaactcctgacctcatgatatgctcgccttggccttccaaagtgctgggattacaggtgtgagccatcccacctggtctaactcttttactttcaatctatttgtatctttgaatctaaagtgtttctcctgttgacagcatgtagttacatcatgttttcttatctagtatgacaatccctgncttttgattggattatctaatcaattcacatttaacactagtatctatatagttaatgtttgcagttttaatttttgttttctatttgtttaatatcttttttgttcctctattacccctattgtgttcttttgcattaagtgaatatttttagagtaatattttaattactgtaattactttttaaactatttttaaagttttttctcagtggttgctctagggtttgccatacatgtcttatcagagtctattccaaatttatacaaacttaattaaagtgaggtacagaaacattattcctatatagttctattccctctttctcct

SEQ ID NO: 851 - DNA, 661 bp, Homo sapiens
  misc_feature [331]..[331]: Chromosome 6, SNP identification no. = rs770904
  misc_feature [331]..[331]: allele = a, a, in linkage disequilibrium with rs508106, rs723142, respectively
  misc_feature [331]..[331]: n is a, t, c or g
acctgctgtgcttggggcagagcctctgtgtggatgggggctatgtggaggaggagagcacttgacttttctacaacactcaccaggaatttagcctatttatcttggattaaaggggataagaaacattgacagtctgccccttctggtgagatgtgttaacacttgattgggagctaaggagggaatccatcttcttggccacacccacttggagtagagcttctttcactagtgtccttttaaacgttacggttctggctaggcagagacacagactgggccttcgctaggtggagacaaattcaacctttgctgtaaagggcctagntttggaatggtagttgtggagagtctgttttctgagaagccggtaataattaacgatcttatttaatccccatttacggatgaagtgaaagtatcctaattcacataaataggaatgacaaaacgggagtcaaagtcaggtgagtctaaccttgaaggcctaaatcatattctactactcactgaaggaacaatttcttcctccattaaaactagagaattcccaaaaattataagggaggagaaataaataaggggttagaaggaaagaataaaaaaaattcaacagaattggtctggatttcccaggaactacctcataactggggga

SEQ ID NO: 852 - DNA, 661 bp, Homo sapiens
  misc_feature [331]..[331]: Chromosome 6, SNP identification no. = rs770897
  misc_feature [331]..[331]: allele = t, t, in linkage disequilibrium with rs508106, rs723142, respectively
  misc_feature [331]..[331]: n is a, t, c or g
atacctatattttgttgagacaaggtttaccgagactggaaggaggattctggtcactttatcggatttgtacgataagaataccgttgtccaattcgtgttctcgttcgtttgcatttagtacatttaggaaaaattctatgacgaacggattgtagacggttatacgatatttggtttcgtttagtgtatgatttcggttccacgtaccttaatgtagggtttgtttcactttcccgggatgtttcaccgtaccgttttccgaacacatttccttccagacttctttaccccgataactacggtagatggtacttgactgtatggtggnaaagaaatttgtggcgggtgctcctacaaaagtcagaacacgataatgtttgttatgtcgttactgactcatgtaacagtagaaggtgtgtccggtcatatagacatcctatttagaaatcttcactttaagaaccaatttcctatatccaaaaacattaaaactatccacaacggtttcgtgacaagtctgtattaactaacattgttaatataaaggtggttgttacaaccctgatacaatagtaatttttaaaaaaaaggtcagaatgtacactttacattagaaacataccgagactaaacataaaaagaacaatttttattctaa

SEQ ID NO: 853 - DNA, 661 bp, Homo sapiens
  misc_feature [331]..[331]: Chromosome 6, SNP identification no. = rs770898
  misc_feature [331]..[331]: allele = g, g, in linkage disequilibrium with rs508106, rs723142, respectively
  misc_feature [331]..[331]: n is a, t, c or g
taaataagtgacacttccattcttatgtctgtattaagattcatcgtattgtagtgtcttttgaataaattttaaaaaaagagaaaacttaaattataaagtctatgtaccataaatcagtcggagatataaaattcattactggttctctttaagattattaagaaataatttctcagttcaaactaatactacttcacttttttatggatctctttcttatcctattctgtgaatagacaaagttcttggatagaataaactaactttaataacagaaaattttccttcaataccatttataaatttaatcgttacaatggattatagnaaaaaattacatgtaataaaggtgaagcctccactgtgccttctacaaacgtccctaagaacagttttacaagaatgggttctacccaagatttggttctgaccttaagtcagttctttaccctcgtcaacgttaacatcggtggtaggtttgagttaattaaagttaatttaaattgtgtcaagttatttacaaataattacacgaaaagacatcatgagtgaaacagaaggtttgtcccgatggaggtttcggtcgttaaagggaatttttttaaatgttatgaccgtgtaactgtccgttagataacgtataggtaccgtctccaag

SEQ ID NO: 854 - DNA, 661 bp, Homo sapiens
  misc_feature [331]..[331]: Chromosome 6, SNP identification no. = rs770894
  misc_feature [331]..[331]: allele = t, t, in linkage disequilibrium with rs508106, rs723142, respectively
  misc_feature [331]..[331]: n is a, t, c or g
agagacagagtttaatcgtttccttaacttatgtgcacttttgacagtctagacttttcattgattttgtttcagttcacaaccacttgttgttcgtgtatacagttttttggtacttggttgtgaattttgattttggtagttgaactcccagttaaactgttttttttttttttttttgggtggtctttaacatgtacatatacacatataagtacttctttattaaaaaattttaacagtcactaatttttcttttgaagttcagtgaaattcatgaacttcacacatttgaagactctacacatttgatttcattttacatttaatnccttacccagttttccttacataaacagagtagtcagtcatgttattcacgacgccgatcattttctttttatatcgggagatatagacacccaagatatagggacctaagttggtttggtgtctatcttttattagttttcttttatttacccaccaatgtagacttggtttgtacatgtctgaaaaattttttaatagtaataaaggattcgttatgtcgtcccgcgccaccgagtacggacattagggtcgtgacaccctccggctccacccgtttagtgaactctagtcctcaaactctggtcggatcggttgtaccactttggga

SEQ ID NO: 855 - DNA, 661 bp, Homo sapiens
  misc_feature [331]..[331]: Chromosome 6, SNP identification no. = rs770895
  misc_feature [331]..[331]: allele = g, g, in linkage disequilibrium with rs508106, rs723142, respectively
  misc_feature [331]..[331]: n is a, t, c or g
tgctttctgtatctgtgccttcgttttcgagagttacgtcttaactcatgccaaaccacacacatagaaaggtcagttacgggagagagaaatatttataaagttaacaaagacgataaaaaatacacttaccctagtatcatatacttaataagcgtaaaaaagaaaaaatttttgttggtagataaaaagacacacgtatgtatatccatacgaagaggaaaaaatttctgactttataaagtttgacatctaacaacatggtgttaaataaattgtcggaataactttctgtaaatctagtcatttatgaaaaatttcttcaaaggangttcactcttttcgaatgatcctagtcaagataaaactaacagaattcgtaaattaatagggtttaatagtatgaatgaaatgaggactgtcgaacttttaaaaaacacgtactacgataaatgtatgagattccgtcccgtctcctaacgtctcgtgtaaaaagggttaaataagaagataaggtttcactttatttccttcctagacttacagggctgtctattcttggttaaatcacataaagttctccagtgaaacatcggacgtcctttgcaaagatgtgatagtaaataaatgttctaacaaagatgtccctggtaaaaagaag

SEQ ID NO: 856 - DNA, 661 bp, Homo sapiens
  TPBG
  misc_feature [331]..[331]: Chromosome 6, SNP identification no. = rs1570140
  misc_feature [331]..[331]: allele = a, a, in linkage disequilibrium with rs508106, rs723142, respectively
  misc_feature [331]..[331]: n is a, t, c or g
tggaaaccgtcactgctctatctaaatccgtactgtctcgtcgcgcttcgtcgtcgtctttctttactcgacttttagatgacgccgtcgtcgtttccgtgccgtccaacataccttcgaagtcttcgagaggggtagtttcaccatgaactccggcgtttgaagtctaaatccacattaattacggaagggcggacagggggggcgggggagtgaagaacccatcactaccttgaacacttctctcgcgcggttgaaattctctctctctctctctttcttttttttttctaatcacctctcctctaagtaaggactaagtaatcgaaangagaatggttttaattttcgtctaccttctctttccgtcggtttccgtagggtctttgttttccgtttatcgtttctgaactcagagggcctttcgcctgggcggggggaggggtctacatcgcgccacacagttcagtgaagacacctctttcgaggttcctactcctcacccctaacgtcctcgactggaccctctcttcaaaccaaagtttcagctaacagggtcccccgtagaccgtctaccactacctctcctaccccaacccctctccctgtttaacttaccaaccaatggccttcctagacaataatatggtctgtccaaaac

SEQ ID NO: 857 - DNA, 661 bp, Homo sapiens
  TPBG
  misc_feature [331]..[331]: Chromosome 6, SNP identification no. = rs770911
  misc_feature [331]..[331]: allele = c, c, in linkage disequilibrium with rs508106, rs723142, respectively
  misc_feature [331]..[331]: n is a, t, c or g
ctcgtggggggtccgtagcgccgagcgcaaaggggcctcgacccgaccctgccgcgggcgaggcttccgagccctccgacccgggcctcccgcgctcggccgccttcgcagaccttttttttttgaaaggagagcaccttggctccctcaccgcggcgtcggccttgaaccgattgggggagcggtggcccgcgaagggagtccccggctaagggggcggggaagggaggtctttcatgcgtgccgcccagccctgcgaggcgaggcgcgaggacgagggcgaggagaaggacggcggcgggaccacggtggagaagcggagaacaaccgnggggagcgacctaggagactccctggaccctgttcgtcctctctccgcacttgtcgccaccgacggcgccgaaggcctcacgtttttggccggaaaagctcagatcagcagaggtcagacagggtctctggaggaaggttttcgggcggggccggagcggaggggttggggaggccagtgaaaatgaggcctccccctgcgcgtaggctgtgggtctggcgtttcagaaggaagaagggaccgggtgtgatttatttgggctggccggagggcgggaggcggaaagggctcctctgagcagagggcgcagattgaatggcgaattagggg

SEQ ID NO: 858 - DNA, 661 bp, Homo sapiens
  misc_feature [331]..[331]: Chromosome 6, SNP identification no. = rs1275806
  misc_feature [331]..[331]: allele = a, a, in linkage disequilibrium with rs508106, rs723142, respectively
  misc_feature [331]..[331]: n is a, t, c or g
tttccatgagtacgatcgaagggttttaagtgtatttaatattcggaaaacgttagacgtcgtatttatgatgtatactacactcttttaactctacatcacacacaggacgtatacatttctgtcatttgaccgtgaagtcgtcggttcgaccgtcacaagccgaccagtcaggggaccaaaaggtcccactattacctaaacgtaactaaattgattgaagggacaaaccaggtccgggaatctcctaccgtcgtacgtggacctcacccgcactcgatcctcttgtgtcgtctcttacgtttcgactgacagagtggaccactgactnactgaattaccagtgcttgaaccagagtaaacaaatcaaaagagtggtcgactcgaattgagtgtaaattccaacttaatatgtttggtcgtgacgtaaggtctcaaaaataaaaagaaaaggtttctttatagtggtaatttaaaggttttatgaaggataatatattatctgagtattctaacaatacttttttagtaaagtttttgtaatttacaaaagcccccaattttgtaccattaaaaattgtttcattttagatctcgtttgacttcgtaagtgagtttcgttgttgttattttgtttgtttaagtggtttcgttaacgtac

SEQ ID NO: 859 - DNA, 661 bp, Homo sapiens
  misc_feature [331]..[331]: Chromosome 6, SNP identification no. = rs770906
  misc_feature [331]..[331]: allele = g, g, in linkage disequilibrium with rs508106, rs723142, respectively
  misc_feature [331]..[331]: n is a, t, c or g
tttttcagtgtaatacgttcattatttggacacgtatgagagaaccacacacacaccagagtagtcagaactataggtttggttaaacccttcccacaactagagtagaaacaacccatgtcggtgtcgatacgtatattgaggaaacgagcatctgaaggttctcgagggggtgacaggtgatttaacatatctttgataaatactatcgaaggtagatctttctatttaaatagaaagatcagaatatgaggtaataagaggaaacatttgtaatgtaaagtttacaatgacaagggtcttttgtgaaccagaagttaacggaggtaanagaaacgaatacgataagagagacaggactcaaaagaaaagatgggtagtagagagaaacggagaagaagttttagtagaattttcgattgagaaggtacttgggaaaaacctaagaggactggtctgttctagagaggaatgaaacttggactatagtggaacaaacttagagaccaccccaaatagtacaagatacgatctttttcgtgtctgtactagcagtaagtgtagaggagatctcgtcctcaattctcgaacctaggacttccgagggggttgtaggaggggtctttttttgttgtcaagtttagggtatagactaagaatg

SEQ ID NO: 860 - DNA, 661 bp, Homo sapiens
  misc_feature [331]..[331]: Chromosome 6, SNP identification no. = rs932614
  misc_feature [331]..[331]: allele = g, g, in linkage disequilibrium with rs508106, rs723142, respectively
  misc_feature [331]..[331]: n is a, t, c or g
tcaacaaagaaacctgacttaccattaaaaccaaaatactggttatttcggtgaattttattcttcgtcgactaaacatacacttcgacgtccaataaactttttatggagctaacgtcacatgtagtccagtcaaatgtattcgtcgtctcctcgggaatttcgacccggaaccactcctgtatccctaatcgtgagaccgtctgtgtactcttcccgtccttacgaacaagagtcgaaaagatggctctcctgttgacaggttggttctaattcgacttttctgtactgtttcaaaagaattgaaattttcctcttgaagtattggtanactaagtatactatttacgtctggagtctagactattaattccagttgtgtaagttttgttccgaactttacagaatgaatagatgttaccacaatgtggttataagttttgattcaaagtcaaagacctttcgtaaaaacgtttttacctacgtcggttatcgtatttttgcctagtaaattacagtgtttcttttagatactcgtgtagacctatcagtttcattttatcacaatgataagaaaattcccttcacgaagtaaaaactcgataaaaaaaaaggtaaaatctgaacatttaccgtaaggataccaggagaaaaggtatat

SEQ ID NO: 861 - DNA, 661 bp, Homo sapiens
  misc_feature [331]..[331]: Chromosome 6, SNP identification no. = rs9344274
  misc_feature [331]..[331]: allele = t, t, in linkage disequilibrium with rs508106, rs723142, respectively
  misc_feature [331]..[331]: n is a, t, c or g
ctggcaatggcttctggagattctggcagtgccgtagtctccacgggagactgaatgcatgaatttggattaagtacaaccgtgagtggcagaagttgaggtacatgtttttttctttcatgttaagagaggaggtttgaatcaagaagcgatatggcaactttgttccacaaatttctcgggagatttctagccttattgctcctctatgcctagtagttagccctaatccttttggtatgaattggcttgagtctagaatcctgtgaggataagcccttgggaggctccactttgtcctccagtaacaagtggactagtctttacaggntgccttttatgtctgtgcgtgtgtgtgtgtgtcaggagagaggataaactcagcttctctacatatattttttctgactcttaaccatgtagtttgcatattgaaaaacagagtatctattaattgcaactgtggtgaaagccctacatttccttttgggctatgtggggttttgtttttgtttttccttctgtagctgaaatgaactatctcactgtgattcacattagtgaggtttcaagaatacttattcaagactttctaagggtcaaggccataggggcatatggggaacaaaagatgaataagaatagaattggtacattctta

SEQ ID NO: 862 - DNA, 661 bp, Homo sapiens
  misc_feature [331]..[331]: Chromosome 6, SNP identification no. = rs1951006
  misc_feature [331]..[331]: allele = t, t, in linkage disequilibrium with rs508106, rs723142, respectively
  misc_feature [331]..[331]: n is a, t, c or g
tttaaatagatagtctgtcaaaaggtttgtgtaaaagaaaaaatggaaggagattttagaacaataagtttcacatcggaggcctggttaccgaagacttgactcaaacaatctttacatcttagagtccgaggtgtggtctggaagagtttgtctgtgatgtgaaattgtttgtgagacttattaaggaggtgtgtgatcaaactcttcgtgacaatattttgtgttgatgtgtccaaagaacattttctctctacccaaaaaattaaaagtcttgattatttcagttaaaaaaaattaagcttttgaaaaggataaattttgttaagtntattacttacatttcctaaaaattgtaccgagatttaaaaagatctttagggggaggtaaaacaacctccaaacaatattatcagggttatacgttatttgttcaatgttcaatgtttgttttcctattaagaactacggtttatattatcattgttgatcaaaacagactacattataatgtttatccggtgcaaataataagacgggagcaaatagtttataaaacatagaacatacatcataaaagccttaaacactattaccttaatacgacgtttaggagactgttttaatatttttcgaaacaagtcttgttctcattggagac

SEQ ID NO: 863 - DNA, 661 bp, Homo sapiens
  misc_feature [331]..[331]: Chromosome 6, SNP identification no. = rs9449462
  misc_feature [331]..[331]: allele = g, g, in linkage disequilibrium with rs508106, rs723142, respectively
  misc_feature [331]..[331]: n is a, t, c or g
attgagtatggtactgacttctgtctactgattttctgagcctttaatacctctaataatggcccatactactggttcctgcccaggtgactatacagcatttacaggtgcaatccagtggatgctgtctaaaaacaaaatgaagtcttgggactattattaacctcattttgagatggaataataataataataataataatagactcaaaagggttaagaggcatgcacttttggcaggaatgggcaagtgaacctcagatgtagctgcaatgggcttccaacactggactttttccaggaaaggcattggcctctctgcttctctttngaacacagctgatttagccacattttgatgtggcatggtgtctgttaaagcaattccaaacatgaggggaatctccttgatgttatgttctatgtatatgtgtccatgtgcacatgaatgtgtgtgtgtgtgtgcgcgtgtgagcatgggtgtgtgtattttcacctctaactctcctactcctgaaccaccaagcagtgctggggctgtgagattttctgcctggatagttccctcttgtgccatcagattctgtcaacatttctctttatcttggataactctttcaggagtcacttaaaactaaatggaaggttatagaactaattt

SEQ ID NO: 864 - DNA, 661 bp, Homo sapiens
  misc_feature [331]..[331]: Chromosome 6, SNP identification no. = rs9361914
  misc_feature [331]..[331]: allele = a, a, in linkage disequilibrium with rs508106, rs723142, respectively
  misc_feature [331]..[331]: n is a, t, c or g
attctattgattaaaaaacttccaaataatgcatggttacatatttttcttggcatgataaacaaatatttgcttaaatgttctgtttaaaactttgatgaattgatacatttggacattgaaatgttatccaaagggaactgaaacattatccaaagaatatgcatttttttatcagaccacaaagctaacaaagcaagaaatacgtttccatatgtctcacctactagctcatatgatgggattcttctaaatttattttcatttggatgacaaaactgcatgcatttcagccagaagttttgaatggaataagatttcagaaattgtntgttgatttcaactacaatagattccatttatattttgagatagcactttatgtagtatttcaaagtgttagattgtatgaatagggagctggagtttggggaggcattcacagagtagcatgactaagaccttgggctatagaatcaaacaggactatgttcaaatcttggtctttctcacttcccatgtgcatgaacttaagcaaggtacatggcttatgtgagtcccaattttcccatttatttatttatttatttatttattttcaggtaattttttaattagaaattccaaattttaaataccacaatatgttatatcacagatg

SEQ ID NO: 865 - DNA, 661 bp, Homo sapiens
  misc_feature [331]..[331]: Chromosome 6, SNP identification no. = rs714133
  misc_feature [331]..[331]: allele = c, c, in linkage disequilibrium with rs508106, rs723142, respectively
  misc_feature [331]..[331]: n is a, t, c or g
gaagtactatattaaaaagagggtaagtttacttcaagatctagacaccttagaattgaatttatgaattgaggataatccgatacagaacacgttgagaccggttaaagtaattaaaaagtaacgaaaccaaagggttgactttttattcctagtattacatcaaggtggagaagtagtgtaagatatcccaacccgatttgactcgtgtttattttataaaaatacattatttccataatgtatttttataattatgagaacatttaaaaattaataatgttaaaatttttgttgtattaaaaggtttatctactccacattcatatantaaattcagtagtaactcgaatagtccacccgtcccctgctttgactatgtgtctataaatgactggtgtaagattacggttcgtgaaatatacgtgataaagtgagttgacagtaatgtcagactccatttatgatgatattctagatgaaatatttacccttttaacgccccctcctcggttctaccggcttatccttgtcgaggccagatgtcgagggtcgcactcgctgcgtcttctacccactaaagacgtaaaggtagactccatggtccaagtagagtgatccctcacggtctgtcacccgcgtccagtcacccacgcgcgtg

SEQ ID NO: 866 - DNA, 661 bp, Homo sapiens
  misc_feature [331]..[331]: Chromosome 6, SNP identification no. = rs1998204
  misc_feature [331]..[331]: allele = g, g, in linkage disequilibrium with rs508106, rs723142, respectively
  misc_feature [331]..[331]: n is a, t, c or g
agtagggacataaatgtctgttgatcttatcaaattatttttaagaatttagggattttgtcagaatcattaattcagccaacctggttagtccatttataccatagcctcaggtttcctatatccacatatgccattcagaattactaaggcatggaaagcgtctcacaaaagaaaaacttttacattatttaaacagtgtcgtatccacaaaataaacgatatgctgttcttggttcaccaagcaagcactttgccatctctgggtccccagtgaacagctactcattaaacccagatacatttggacatcagaccccctctctaacanggaaaggggtcaccacagggaggaatgcaggcctgccagtcagagtcatctcccaccagaaacctgctttaatgagcattttcttgcttctcagggcaatcctcatgctctcactgtgctctcagcaagaacacctgggattcttcagccttgccatgtgtggagaacagcccaaaaataggcctgctaagacttccaagatggattgctagactttgtgagtcacctctgaaaccaaaagctctgtgctttgtgatttttgtttgcatcattaggatgaggaatttcagcaaacctaaccacaattacctgtgactaatcttagcagat

SEQ ID NO: 867 - DNA, 661 bp, Homo sapiens
  misc_feature [331]..[331]: Chromosome 6, SNP identification no. = rs1853143
  misc_feature [331]..[331]: allele = t, t, in linkage disequilibrium with rs508106, rs723142, respectively
  misc_feature [331]..[331]: n is a, t, c or g
tgtgtatattagggctaacttaaaatatatatcccctgattctgctcagttatgtgatcttatacccattttactttctaccccaaagttactggttcctgaactaggaagtgctgtaattttagaagcttctaaaggaatgcaaattctttttggccaaatgtgactcacaatacaaacacaggaacaattgtttacttctgtaaattctaagatggtgcaggtttggtcagaaatgtaattaccttagggccagactagaataacagttaaataaaaactggaagagaagatgtttttatagaaattaagttatgggagagtaagatanatatccagaaagcaggtttctgcctttcagaggagaatattttcttaaagtttgtgaaagggtgcaaggggcaagggttggattggttctcagaccactgaggggattggcaggagactaaagtatggaaccactggggtgctggaactcacccacatgggcttgggagagccaattattatactgggattacaggtgtgagctagactgcctgacctaaaattttgttttttacaaagtaataaatactcaaaatttatcactccctaattatttaactacatttttactattatctgtgccattgaggttatttatgtctatttgtat

SEQ ID NO: 868 - DNA, 661 bp, Homo sapiens
  misc_feature [331]..[331]: Chromosome 6, SNP identification no. = rs4706945
  misc_feature [331]..[331]: allele = c, c, in linkage disequilibrium with rs508106, rs723142, respectively
  misc_feature [331]..[331]: n is a, t, c or g
caactatgcatttctttctaactctactttcggtaacttcgtgttgaaacttaaatttgataatggtgggagtatttacatgagggaaattggcaagcagcacagcttgatttattgttttgttgattatctaaatcaggattcagtaaaagagggcatgcttgctatgtgttgttataaataaagtttccctggaacacagccatgtccatttacttatgtactgtttgtgactagttttatgctaccatggcagagtagttttaacagagatgttagacccacaaagcctaaaatattcactgtttggcccattatagaaaatgtttcnatacccttcatctagactttaaaaagtgatgagtaaatgttaaaaatgcaaattaaacttaaaagcatgtttttttagtagctattacattgtgattagcacacaaaactgaggaaatacttttttcaatattggaaaactgttatctgattcagtaatcacagtattgactattatgtttgaacttaagtgtgctgaaccaaaaaaaggttttaatttaatgaatataatctgtatgatggtggaagatagcttaatagtagatcacatgtcagacttaatgacaaaaataaaaaaattagccaggcctggtggtgcgtgcctgtagtc

SEQ ID NO: 869 - DNA, 661 bp, Homo sapiens
  misc_feature [331]..[331]: Chromosome 6, SNP identification no. = rs9449469
  misc_feature [331]..[331]: allele = c, c, in linkage disequilibrium with rs508106, rs723142, respectively
  misc_feature [331]..[331]: n is a, t, c or g
ttttagtagagatgggggtttcaccatgttggccaggctggtcttgaactcctgacctcgtgatccacccatgtcagcctcccaaaatgttgggattacaggcatgagccaccgcacccagcctgttatgcctattttaccacaatttttaaaaaagagttagtggattgagatacaactctgtttgtcaaattatagttaattgcaatcataggttggctatggatataggaattgagcaaaaatcaactaaagcattctgtgagaatcagttggaatttataataaagtatattgtatattttattatcattagtaaactgtgtgctanatgtcctttatattagtaaagtttagaataaacttacatacatatgtaacatatataatatcgtatattctatatataatatatatacacacacatacacacatattcccaacacagagctggttgttaatatttaccagcacaccactgtcaagattgggctttctcttatccaggaactgagatccgctctggtggaaggatcccaggtggcctgggttcgggttcccaggttctatgtctgactcctccacttaactatctgtacgactctgggcaacttgcttagttagactctcaagtgttagtttcctcttctgttaaatgaga

SEQ ID NO: 870 - DNA, 661 bp, Homo sapiens
  misc_feature [331]..[331]: Chromosome 6, SNP identification no. = rs9449470
  misc_feature [331]..[331]: allele = g, g, in linkage disequilibrium with rs508106, rs723142, respectively
  misc_feature [331]..[331]: n is a, t, c or g
tgtaacatatataatatcgtatattctatatataatatatatacacacacatacacacatattcccaacacagagctggttgttaatatttaccagcacaccactgtcaagattgggctttctcttatccaggaactgagatccgctctggtggaaggatcccaggtggcctgggttcgggttcccaggttctatgtctgactcctccacttaactatctgtacgactctgggcaacttgcttagttagactctcaagtgttagtttcctcttctgttaaatgagagctagattgagtaatctgtaagattttctgctattaaaagctatnaccagccaggcgcattggctcactcctgtaatcccagcactttgggaggacgaggcaggcagatcacaaggtcaggagtttgagaccagcttgaacaacatggtgaaaccccatatctactaaaaatacaaaaattagctgggtgtgtgcctgtaatcccagctacccaggaggctgaggcaggaggattgcttgaacctgggaggtggaggttgcagtgagctgagattgcactactgcactccagcctgggtgacagagatagactccgtctccaaaaaaaaaaaaaaaaaaaaaaaaaaaaaaaaaaaaaaaatgactatagcattg

SEQ ID NO: 871 - DNA, 661 bp, Homo sapiens
  misc_feature [331]..[331]: Chromosome 6, SNP identification no. = rs4706948
  misc_feature [331]..[331]: allele = g, g, in linkage disequilibrium with rs508106, rs723142, respectively
  misc_feature [331]..[331]: n is a, t, c or g
tctccaaaaaaaaaaaaaaaaaaaaaaaaaaaaaaaaaaaaaaaatgactatagcattgtaaattccgtgaaatgaggggctgttttttatctttgcatttacataagcacgtaacatagttctttgcacactcaattaatgtctgtcaaattaagttgaatagcgtttttctcaaaatgttgtggattcttaaatataataatagctaatatttcctgccttactatgcaccagctgctttatctcatgtaattcttttaattctatgtggtagctacagttaccgattccgcttatacaaagtaattgagatttcctgagatgtcacanctaataaatggcaaactgagattccaacttggatctatctcacttcacagaaaccctcttaactactatgctacactactttttatccagaactaagatcttccctgaaatgctaatcatggagaatccttctgcatgccagaaagtgaaatgacaaataaatctttacatttattcattgcaaccctggaggtgctatcatctgtgtctcaaatttagtttgcagcaggatcatctgcagttctgaaatgcatattcctgagccccgccccccgacctattcaatcagaatctctaggggtggtgccacaaagccacatttttattttt

SEQ ID NO: 872 - DNA, 661 bp, Homo sapiens
  misc_feature [331]..[331]: Chromosome 6, SNP identification no. = rs2875128
  misc_feature [331]..[331]: allele = c, c, in linkage disequilibrium with rs508106, rs723142, respectively
  misc_feature [331]..[331]: n is a, t, c or g
ctgactcctgaggtgccctcggcctcccaaagtgctgggattacaggtgtgagccaccatacccagccaagaagctacatttttatctgaactatcattttgatatggggaaccctggaccacatttaagagaagcaccagccaagagcagggactttcaaacacttttaaccacaacctagagttaagaaaacattttatattgtgacccaccattcatatacatgtgcccacaaaaatgtgaacattctgatattttccaactctattccattccattgtactttttaaaactaatggtcaagtttcataaattgattttatttcccantagtgggtcacaatttgcagtttataaaatactgacttagaaaggttatatttgtaccatgtgccttcttttttcctgatttaagagtttgcacattagcgagacagaaagtccagctgtcattcctgtatacctcagttagctcacctgattattccaggcagggctggatttactccttatcctctgttcccagaaagaaaaggatgaagttttttcccttgaaagggtttttgaaagtgtcatttaactagcgatttccgttagtcccaccactccaccaatacgagttatggcagctctgtgtcccattagtgagctctttcccct

SEQ ID NO: 873 - DNA, 661 bp, Homo sapiens
  misc_feature [331]..[331]: Chromosome 6, SNP identification no. = rs6912008
  misc_feature [331]..[331]: allele = c, c, in linkage disequilibrium with rs508106, rs723142, respectively
  misc_feature [331]..[331]: n is a, t, c or g
tttatattgtgacccaccattcatatacatgtgcccacaaaaatgtgaacattctgatattttccaactctattccattccattgtactttttaaaactaatggtcaagtttcataaattgattttatttcccattagtgggtcacaatttgcagtttataaaatactgacttagaaaggttatatttgtaccatgtgccttcttttttcctgatttaagagtttgcacattagcgagacagaaagtccagctgtcattcctgtatacctcagttagctcacctgattattccaggcagggctggatttactccttatcctctgttcccanaaagaaaaggatgaagttttttcccttgaaagggtttttgaaagtgtcatttaactagcgatttccgttagtcccaccactccaccaatacgagttatggcagctctgtgtcccattagtgagctctttccccttcagctctgtgggacaggctgcagggcccagatctctctgagcatctcctacctggcacagcacaggatttatttagcatttggcctagggtttgtcccactgtttcagagtttgctaccattactgtagtaggtatgaataatttttcaagtgtaagcttgtgacttctttttttgctcctgaaattattgatca

SEQ ID NO: 874 - DNA, 661 bp, Homo sapiens
  misc_feature [331]..[331]: Chromosome 6, SNP identification no. = rs9449475
  misc_feature [331]..[331]: allele = c, c, in linkage disequilibrium with rs508106, rs723142, respectively
  misc_feature [331]..[331]: n is a, t, c or g
tgctgaaatgatctcacataccttcatcttagcaagtcctttagatttcatttgggaattaagatatgaaagctctttccagggttatttttatgggatgagtatgtaagctgaaaataggaaatatagtttggttaaggggagctacatttgggatgatcaagcacaaattcctaatttattttatgttagcaacagaaggctgtctttgtttttcttcctttcctctccttttattctttttttttttcatttattcagctacctatttgacacatatttattggagcctacagtgtaccaggcactggtgtaaaaatgcaataccaanatgtcctgatactcaggagactacaatctaatggtgagggagactctagttaatcaatgattataatattttaatgaaagaggtatctgagtcagggcagtcaggtaaagctgttccaagggggtgacactgagctaaatttcaaagggtgagtacaaggatgaagaagccaaagaaggaggtaatagagactttgtcttagtttgggtttccctgaattcagagcctgcaataaggacttagaggcaggtagttaatttacagcatgagccccagaaactggagtgagagagtgtgagacagagaaagaaaaacaaagtcaaagtagat

SEQ ID NO: 875 - DNA, 661 bp, Homo sapiens
  misc_feature [331]..[331]: Chromosome 6, SNP identification no. = rs967730
  misc_feature [331]..[331]: allele = g, g, in linkage disequilibrium with rs508106, rs723142, respectively
  misc_feature [331]..[331]: n is a, t, c or g
catatttattggagcctacagtgtaccaggcactggtgtaaaaatgcaataccaatatgtcctgatactcaggagactacaatctaatggtgagggagactctagttaatcaatgattataatattttaatgaaagaggtatctgagtcagggcagtcaggtaaagctgttccaagggggtgacactgagctaaatttcaaagggtgagtacaaggatgaagaagccaaagaaggaggtaatagagactttgtcttagtttgggtttccctgaattcagagcctgcaataaggacttagaggcaggtagttaatttacagcatgagccccngaaactggagtgagagagtgtgagacagagaaagaaaaacaaagtcaaagtagattgagctcattgccaactatggacaactgggacttaattccactggggacctctggaggaatgtaggtactatagaattatctctcctcccaaggacaagtggtgggggttctgtccgttgtctcctatctttattgggatacaggatgtgtgtgtgtgaaggctggggtggaggaaacatgaagaactgactggtttttctcattctttgtggctagtgacaaatggggtgcagttgagggggtttttaaaatcttgtattattttctaaatgtt

SEQ ID NO: 876 - DNA, 661 bp, Homo sapiens
  misc_feature [331]..[331]: Chromosome 6, SNP identification no. = rs967731
  misc_feature [331]..[331]: allele = g, g, in linkage disequilibrium with rs508106, rs723142, respectively
  misc_feature [331]..[331]: n is a, t, c or g
atcaatgattataatattttaatgaaagaggtatctgagtcagggcagtcaggtaaagctgttccaagggggtgacactgagctaaatttcaaagggtgagtacaaggatgaagaagccaaagaaggaggtaatagagactttgtcttagtttgggtttccctgaattcagagcctgcaataaggacttagaggcaggtagttaatttacagcatgagccccagaaactggagtgagagagtgtgagacagagaaagaaaaacaaagtcaaagtagattgagctcattgccaactatggacaactgggacttaattccactggggacctcnggaggaatgtaggtactatagaattatctctcctcccaaggacaagtggtgggggttctgtccgttgtctcctatctttattgggatacaggatgtgtgtgtgtgaaggctggggtggaggaaacatgaagaactgactggtttttctcattctttgtggctagtgacaaatggggtgcagttgagggggtttttaaaatcttgtattattttctaaatgttcttcatttcatgtgagttgaggcttacttaaattttcctcaatccagctcatgattccttgcaatttgaatagattatttccatagtctgatctcagtgttaagtgat

SEQ ID NO: 877 - DNA, 661 bp, Homo sapiens
  misc_feature [331]..[331]: Chromosome 6, SNP identification no. = rs9361923
  misc_feature [331]..[331]: allele = a, a, in linkage disequilibrium with rs508106, rs723142, respectively
  misc_feature [331]..[331]: n is a, t, c or g
acaccataaagaatagacatgcaagtattgtcatgtctgctctaaaagtagagctagtgaattacagattataattagaatgagagactaaatgatatttagggccatgtgcagggcttacttcttgaaatacatggctgccaaatgcttatggtcacattttaaatatttatttaaatccaaggggccaatcactttttatacccagtcttcaggaccacctgtcccaagctacagttagcatgctattaactactgttgtttccatgatcactaatagcatccatttctcttattgcacagtatttcaacatgattataggaacattcnaattttaaacttggaaagaacttctaaaattatatgtatggagtgcttttccatttcaaaatcagttaggtatatggaacactcacataaatgtttagtaactggttctctaggggaaaaagccctgatttaaaacttttgacagtctttgtggtgtaaatattcccaccatttcaagcttccaacgttacttcacggaatgtgccattgtttttgtagtatttctaccacacagatacatgtaaataaacttgacagcctaaataatagaaatatgtagtaaaataattaggaagtaatgaattttgaatatttgtagccgttgttttt

SEQ ID NO: 878 - DNA, 661 bp, Homo sapiens
  ARHGAP18
  misc_feature [331]..[331]: Chromosome 6, SNP identification no. = rs9385502
  misc_feature [331]..[331]: allele = t, in linkage disequilibrium with rs10499162, respectively
  misc_feature [331]..[331]: n is a, t, c or g
ctggactacaggtgtgtgctaccacgtccagccaatttttatatttttagcagagatgaggttccactgtcttggccaggctggagatgagaatttttctaccaaaatgacaggccaaacagacctccaccatgggctgtgatgtcagaaagcttccactgcaggttagatggctcttctctagtgacacctgaacaacactgatttatttttcacatctcagcttgactccccagtgaagcctctctcatgcttacttcctgttttgtagattacggtaccctggtcaggcttcaatcacatacctctgagctacatcccttctatatgncttctcctggctcctcgagggtgagcacccagctccctgactccctgggaacacctaacataaagtgggggcctagcaccaaggtggcaatagcattttgttgatgagtaactgaatttcacataaggaaagaaaaaaaaaaactcaaagaggtaaagttacagctaatatgtgatgaaactgatatttaaatcccaagctttaaaatgacaatacagtttttaaatagtacagagatcattctcagaccagatcatgtctaactatgccaaagtgcaaactaaagaagttaatgcttttttttccataaatgacaaaattactaaaata

SEQ ID NO: 879 - DNA, 661 bp, Homo sapiens
  ARHGAP18
  misc_feature [331]..[331]: Chromosome 6, SNP identification no. = rs10499162
  misc_feature [331]..[331]: allele = c, t
  misc_feature [331]..[331]: n is a, t, c or g
gtagattacggtaccctggtcaggcttcaatcacatacctctgagctacatcccttctatatgccttctcctggctcctcgagggtgagcacccagctccctgactccctgggaacacctaacataaagtgggggcctagcaccaaggtggcaatagcattttgttgatgagtaactgaatttcacataaggaaagaaaaaaaaaaactcaaagaggtaaagttacagctaatatgtgatgaaactgatatttaaatcccaagctttaaaatgacaatacagtttttaaatagtacagagatcattctcagaccagatcatgtctaactangccaaagtgcaaactaaagaagttaatgcttttttttccataaatgacaaaattactaaaatattccatttccaaaaagtaaacgtttcagtttttctaaatattatttaaaaggtacaccccaaatgtttccttaagtagatcctgagcttcagaatatcacagctaaatgccctataaaaagacaagactataaagtcacttaatatgaataagaagggctacaaaacagacttaattcacatatttacaatggtcttagaggtaacagaacattctaaagttaaccaaatgccaaaaaaaaaggctttctaaaagcctttaggataa

SEQ ID NO: 880 - DNA, 661 bp, Homo sapiens
  ARHGAP18
  misc_feature [331]..[331]: Chromosome 6, SNP identification no. = rs9402145
  misc_feature [331]..[331]: allele = g, in linkage disequilibrium with rs10499162, respectively
  misc_feature [331]..[331]: n is a, t, c or g
attttccgtgttttgcttcctcacttggtttacaataaacttgggaatctatagagaaaaggaattaagcttagagaggaaaaagaaatgccaccattttaaactacaaaaaaaaattatatttttttaaatttcaaaaacagtaaagagtttctctttttgataagactgccattttacatgcactattcattaaatctgtgaaaagaaaatacttcatattattcacttaccaggtgtacagggcatccacgtggtataatttgccacccactgtggaaggttccaaaagaggctttgtgaagttcaaggacatagtggccgttttctntgccagactggagaccccctgaggtgacgagcagtagaagccacctccgtaggtctttccttttgcagcctcctacctacagccctgctagctaacctcaagtccccttctaataaccagctagccgctgctgtcatgagagaaagaactccccaagaaacaagagctgataggtagctagcaaaaatccagaacaaatttatcctaagaaatcacattagcaaaaacaaaatattttaaggtatcaaaatgtaaccatgaaataattttgacatttcaaacattgagatttaataaatggacattaattttttattaaaaaaacacatt

SEQ ID NO: 881 - DNA, 661 bp, Homo sapiens
  ARHGAP18
  misc_feature [331]..[331]: Chromosome 6, SNP identification no. = rs9375636
  misc_feature [331]..[331]: allele = g, in linkage disequilibrium with rs10499162, respectively
  misc_feature [331]..[331]: n is a, t, c or g
cttgaactcctgacctcaagtgatctgcccgcctcagcctcccaaagtgctgggagctcaccataattattaatagtgccccttttcattcttataagtgtccctgtttaaaagataaagatacagttacttgaaggcagtgatggcatttttacttttcttcatggcctctaggtgtaaaatggataattaggccagtagataaaccttataagatctaggttcactggaaaaagaatcgagaactattagagacactaatgtgtagcttgcccaagacgacaaaatggcagtacataagaagcagcttgtgaccttccaccaatgaggnagcaaaatgctttgctccacacttctgcatgacaacctcagaatttaatttttcaagaaatgctcagagaccctaccacttctccttgtgcttttatgataactgttcatccacagcttctccagtaagtgttgctttttaacacttggcaagaaaattgtatcagagatcttatgtgactcattctattataagagaaacatgaagtttccaggttttaacactgaaatatattgtattgcttaaatgtcgtgcaattaatctgtacccaaagagaacattctgttatctgtttactcaggaatgcatatttataagaaaaacagaaaa

SEQ ID NO: 882 - DNA, 661 bp, Homo sapiens
  KIAA0960
  misc_feature [331]..[331]: Chromosome 7, SNP identification no. = rs2355084
  misc_feature [331]..[331]: allele = c, g
  misc_feature [331]..[331]: n is a, t, c or g
acatgggaataatagatactagggcctacttgccagggggagggtagaaggagggtgagtcaaaaaattacctatagtgtactctgctcactaccagggtgatgaaatcatttctaaaccaattccggtgacatgcaacttacctatgtaccaaacctgtacatgcaacccctcaatctaaaataaaagatgacaaaaaaagttcattttgataaataaaatccaacaacagtcaagataatttcaaacgtgggcagcaatggtgacaaaatgtgtttttaaaaaatactagaagaaaagaaactacagtgattaacactgatagtcatanagaaatcaacaataatattaatgaaatagaatgaagagcctaagaaacctctgtgtacctaagaatttggtatataataaaggccccatcatatgtttgcttgcaaagaaaggatgaatatttttaacactgaaagatgcttccttatagactatgctaacaaaaaatgcatatttatggaattttacacatcaatttagtagttaaatgtaaagtcaatacctaaagaataacagaagtggctgggcacagtggctcacgcctgtaatctcagcactttgggaggccgaggcgggcagatcatctaggtcgggagttcgtgaccagcct

SEQ ID NO: 883 - DNA, 661 bp, Homo sapiens
  CACNA2D1
  misc_feature [331]..[331]: Chromosome 7, SNP identification no. = rs11768310
  misc_feature [331]..[331]: allele = c, in linkage disequilibrium with rs10280428, respectively
  misc_feature [331]..[331]: n is a, t, c or g
agattgtgtcttaccacaagactaaacttggtccaggtaattttcacacaatctggtctctctgttcacagcttaagtgatcaaaactaattggacctaaatatctgtaacaatacaaaaatgatataattgcatgctattttctatgtcttctcttttaagtgacaagaaaaaaaggcacagtgattacacaaacaaaacactttttaaaaacctggtattgatttatttaaagtaaatcttgtgaatcaaaaagaaggactaaaaatatattaattttcaaatgaacaatgtattttattttgaatcataagtgaaaatacatgttacntgtatgatattttattgttagatttggctagtttccatttcaagacatttaacatataaaaatagtatgtgtgcatgctcatgtacatgtacatatatattacatatgacagagaggaaaatttgagtgacaaaagtactgacaaattataattttcagaattccaggacaaaagagctcataaggacaaaacacgaggctcaagtaattaataaaacagttctgtggcattttttgtttatgctaatatcttcccaaatgacactttgatgtgtgccatcttaatatatcctgaagagcacacaggcctgtcttcctactcccaagctg

SEQ ID NO: 884 - DNA, 661 bp, Homo sapiens
  CACNA2D1
  misc_feature [331]..[331]: Chromosome 7, SNP identification no. = rs10279911
  misc_feature [331]..[331]: allele = t, in linkage disequilibrium with rs10280428, respectively
  misc_feature [331]..[331]: n is a, t, c or g
ggtggtcatggccataagcttccagatggcttcatgctgtgagagacttcctcgctcttgcattcctgttcaagggctgcccaataaaacctgttttgtggtaatgcctctcatggtcatatctttcctcaatcaggccccaaatcctttgaaccccctacacagcccaaccctgtgcaatcctgcagtcctagccaaggtacctttcccagactgaaaagtgtcatgatatgcagtacgtactcttgaaatagttattcccttatttacttataacatataagtaactctgaaattcttcagctcttaaatgaagtacgtaactgttatnaaaaaagtaaatgctgagcagggggtgataaggaggtgtcagggcagtactatccatatattatggtagctttgggttgcagcacattggctggatccactatgattagtggactatatgtaacattttaaaattgaaccctttgaagagtaaatgtgagtagcatatatgaacgcatgggacaggacttttcctggtaaactggaacatatggttaccctaattattttgacaatgacatatttaaaaacttgatactggaggccatgggaccctctatgaaaaacacaggttatgaagactctttcctacttggtgatgtcttacgtt

SEQ ID NO: 885 - DNA, 661 bp, Homo sapiens
  CACNA2D1
  misc_feature [331]..[331]: Chromosome 7, SNP identification no. = rs10280428
  misc_feature [331]..[331]: allele = a, c
  misc_feature [331]..[331]: n is a, t, c or g
taaggaggtgtcagggcagtactatccatatattatggtagctttgggttgcagcacattggctggatccactatgattagtggactatatgtaacattttaaaattgaaccctttgaagagtaaatgtgagtagcatatatgaacgcatgggacaggacttttcctggtaaactggaacatatggttaccctaattattttgacaatgacatatttaaaaacttgatactggaggccatgggaccctctatgaaaaacacaggttatgaagactctttcctacttggtgatgtcttacgttaaagtacgcaacactggcacagctgatanaatacagttgggggtatgcacatgaatgaatcattctattatttgtagatcaatgattaaaaagccacagatggattccagtgaattactcctgaggaactgaaagcattttcttgggctatccaatggcaatatttgttgttctccttttcccttgtctcttcttcctctctgtctctgctctgccacgcccccttgtaatacaccactgtttcgtactttttctcctttttttccttctctcccatatctgcttatttaacatttgtgtgtctgccagtagcttttatagatattacttgctatctaggggctttaatcacctagaca

SEQ ID NO: 886 - DNA, 661 bp, Homo sapiens
  CACNA2D1
  misc_feature [331]..[331]: Chromosome 7, SNP identification no. = rs11763784
  misc_feature [331]..[331]: allele = t, in linkage disequilibrium with rs10280428, respectively
  misc_feature [331]..[331]: n is a, t, c or g
ttgtatcttgtctcattcctttaagcaccaggtcaaatgtcaccacctcacagaggaattctcaaccatactacataaattcatcacttttccctgctttctgtccttcacatcaggttcctattgtttcttcagacactcacaaccatgcaattattatatttgtctatttacttgttttcagcctcttttctccagaatgtaaacagcccaagagaaagtgtttttcaccagaagtcaaaagcacttatctttgcactgagataaaatagttgcctagataaatattaaatgaataaaaaaaagatgactctttgaggcaagcaagcanagtagtcaaattggtatattagcaaggcgtgatgaacaaggtttctactggaaaagcatggactttttaatccaataatttctctttttttcttaactagtagaatggagaggatatgggtaaaaataatcttagctgacacagagaccataaagtttcttttaaagttatgtgcaaaaaatttttctatttgcaatatctgaatttgtatataaaatgtccacaaaactgtttcatatggagtcagaaaaaaaaaataaaaggatcactgtttcctcataaaatttcaaaattcaagaagggtgaagccatcgcattagcaacctcaat

SEQ ID NO: 887 - DNA, 661 bp, Homo sapiens
  CACNA2D1
  misc_feature [331]..[331]: Chromosome 7, SNP identification no. = rs11768220
  misc_feature [331]..[331]: allele = c, in linkage disequilibrium with rs10280428, respectively
  misc_feature [331]..[331]: n is a, t, c or g
ccagcattcagatttagcaacaccttaataataaaagctttttatacagcagtgctttgcacaatgtagttgcttaaattttgttggtaaaaacaaagcacatacctgctttgaaaatttaaaaaaagaacacactaaacaaacaaaaatgccccccaaaaaaagaaaaaagactacaaaagaattctttcccctggcaacacccctcttggatatgtagattgtatctgctgactacgtggctcagttttcccttattaaaacctatctcaataaaatcattttgaaagtagaaaataagggatctctctaaaggattaagtacgtagcnggatttagaattcagaaaacagattccagttttctaatccccaacaagctaagggcactaatgcgaaggaatataagagatttactcccaaaaatatcatattggatctgaatttcaaatgaaaaattggcactccctcctggagtcagagagatagaagaaaaaatgagcagaaacaatacagaaacacaactttcaaacagaatgtcccaccctcacatgcccccaccaacatacacacgcatgcacacacactgaaacactgaggtctttcacttttctatctgtcttaccccatcaccctcaggccagtggagaatgcagtcactg

SEQ ID NO: 888 - DNA, 661 bp, Homo sapiens
  CACNA2D1
  misc_feature [331]..[331]: Chromosome 7, SNP identification no. = rs11770457
  misc_feature [331]..[331]: allele = a, in linkage disequilibrium with rs10280428, respectively
  misc_feature [331]..[331]: n is a, t, c or g
acatcccttcatcatcccataacccaccttctctccactatagcattacttttaaattgtcaagtttattacatttacattctattttcaaactataattgtctcctatcacagtatccatgaagcagaaagttttggcattaaagcatggttcatttcaaatctcaaattttctcacctccaaagaagatgataaaattaaagtaggaaaattagttttgtgatcaactggaaaggtagaaaacatccaaaacatgtacaacaactcaagcctgtgctttcatgtaattcataatatcaactttatgtcaatacttcctttataccagantctagacatagaggaaaaaatcctatgattgataggtaaaaatatcctatgattaagttttatatgtttggagaattgatcattcaatttttgatgtgagtgattccaaactattatataataaaaagtctgctctaactctagacattctgctagaacatatttttatagagacaggcggcaagtgagagggaagggcctccattcaataagcattttgactaatttcacaaaattatatattttgtgaaatatataattaaaatttatataattaaaatttcacaaaattataaattttcacaaaactttataacctcccaactactc

SEQ ID NO: 889 - DNA, 661 bp, Homo sapiens
  misc_feature [331]..[331]: Chromosome 7, SNP identification no. = rs12532655
  misc_feature [331]..[331]: allele = t, in linkage disequilibrium with rs850470, respectively
  misc_feature [331]..[331]: n is a, t, c or g
tctctgctcacagcaagctccacctcccgggttcgcgccattctcctgcctcagcctcccgagtagctgggactacaggtgcccgccactatgcccggctaatttttgtatttttagtggagacgggtttcattgtgttagccaggatggtcttgatctcctgacctcgtgatccgcccgccttagcctcccaaagtgttggggttacaggcgtgagccactgcgcccggccgagcacagtccttttaaaactagtttgtattaaaggtttgtgcccacaatgatttgttttttatactcattttattttataaaaagagaaatgcatatncataagaaattaggaggtaaagcctggaagtgagatattcaaataactctttttctttggaaactccctcaggctatcatgattgattactcctaatttccttttgaaacaaaatgtcaggcatagatccttaacagaacttgagctttaagtgttttgccggatcagtgactagagttgaaataaaatctttagagtgggtaatagaaaaacattttaaaatcagcctgaattttttccaaacactttggaaaaaattataataaatattatttattgaaacttttaacaacttaagcataaatgtatattgatggtatggacaggttt

SEQ ID NO: 890 - DNA, 661 bp, Homo sapiens
  misc_feature [331]..[331]: Chromosome 7, SNP identification no. = rs12534416
  misc_feature [331]..[331]: allele = g, in linkage disequilibrium with rs850470, respectively
  misc_feature [331]..[331]: n is a, t, c or g
tcgcgccattctcctgcctcagcctcccgagtagctgggactacaggtgcccgccactatgcccggctaatttttgtatttttagtggagacgggtttcattgtgttagccaggatggtcttgatctcctgacctcgtgatccgcccgccttagcctcccaaagtgttggggttacaggcgtgagccactgcgcccggccgagcacagtccttttaaaactagtttgtattaaaggtttgtgcccacaatgatttgttttttatactcattttattttataaaaagagaaatgcatattcataagaaattaggaggtaaagcctggaagtnagatattcaaataactctttttctttggaaactccctcaggctatcatgattgattactcctaatttccttttgaaacaaaatgtcaggcatagatccttaacagaacttgagctttaagtgttttgccggatcagtgactagagttgaaataaaatctttagagtgggtaatagaaaaacattttaaaatcagcctgaattttttccaaacactttggaaaaaattataataaatattatttattgaaacttttaacaacttaagcataaatgtatattgatggtatggacaggttttgtggccgttcatagcacgaataaaaaggaaa

SEQ ID NO: 891 - DNA, 661 bp, Homo sapiens
  misc_feature [331]..[331]: Chromosome 7, SNP identification no. = rs7805406
  misc_feature [331]..[331]: allele = c, in linkage disequilibrium with rs850470, respectively
  misc_feature [331]..[331]: n is a, t, c or g
ggtaaagcctggaagtgagatattcaaataactctttttctttggaaactccctcaggctatcatgattgattactcctaatttccttttgaaacaaaatgtcaggcatagatccttaacagaacttgagctttaagtgttttgccggatcagtgactagagttgaaataaaatctttagagtgggtaatagaaaaacattttaaaatcagcctgaattttttccaaacactttggaaaaaattataataaatattatttattgaaacttttaacaacttaagcataaatgtatattgatggtatggacaggttttgtggccgttcatagnacgaataaaaaggaaagacaaatgaacactgttcataatctataactaattatttgcattatcacaacataaagagatgctataacactaaatgattattggaaaaatattaataggtggttaaaaatagtgaaatttagatttcaattatctaatctatattgagagttgttttgtataaaaatgactgaaatcgcatatcttttacaaaattaagatgaagtgaaagttttgaatagattatctctcaactaagtaaatttttaaaacaacatttttttaaaaaactgccttaagcagttaaaatttcttccctgtttaagagttata

SEQ ID NO: 892 - DNA, 661 bp, Homo sapiens
  misc_feature [331]..[331]: Chromosome 7, SNP identification no. = rs12533991
  misc_feature [331]..[331]: allele = t, in linkage disequilibrium with rs850470, respectively
  misc_feature [331]..[331]: n is a, t, c or g
atcacaagataatttaattgcatctgaaaagttgttttgaatttaagataccatgtattactgtggtctcatgttgctaatgaagacatacccaagactgggtaatttgtaaaggaaaaaggtttaattggctcactgtttcacatagctgaggaggcctcataatcatggcggaaggcaaaggggaagcaagacatgtcttacatggtggcaggcaagagagcttgtgcaggggaactcccatttaaaaaaccatcagctttcatgagacttattcactaccacaagaacagtgtggggcaaatcacccacataattcaattatctctanctggccatgtcttcgacatgtagggattatgaccattcaaggtgagatttgggtggggacacagccaaaccatatcataccatattcacagatgcagggaattaggatatagacatctttgggggaccataattaagccctcacaataacatggtataaatgacccttcaaaacgttgcttttctttcttatcatgtataatgttgatggatattgttgtctaaatccctatctgcataccagaggacaagataatgacataaataaatacatgtacaccatgtttacaaaagtaataaaataataggcttactatagaaaataagactc

SEQ ID NO: 893 - DNA, 661 bp, Homo sapiens
  misc_feature [331]..[331]: Chromosome 7, SNP identification no. = rs12533483
  misc_feature [331]..[331]: allele = a, in linkage disequilibrium with rs850470, respectively
  misc_feature [331]..[331]: n is a, t, c or g
caggcaagagagcttgtgcaggggaactcccatttaaaaaaccatcagctttcatgagacttattcactaccacaagaacagtgtggggcaaatcacccacataattcaattatctctatctggccatgtcttcgacatgtagggattatgaccattcaaggtgagatttgggtggggacacagccaaaccatatcataccatattcacagatgcagggaattaggatatagacatctttgggggaccataattaagccctcacaataacatggtataaatgacccttcaaaacgttgcttttctttcttatcatgtataatgttgatggntattgttgtctaaatccctatctgcataccagaggacaagataatgacataaataaatacatgtacaccatgtttacaaaagtaataaaataataggcttactatagaaaataagactcataatgcactttttctttctccttgttatctaatctgaaaaacaaatataattaaaatatttataaaattccatagatttaatttttaaattgagaatgtactttaatatcatctatgccaaatgctatagtatgctttctctttcatttgaagatttatcaacataacttctcagaagtatttttctcgagatatgttatttactatata

SEQ ID NO: 894 - DNA, 661 bp, Homo sapiens
  misc_feature [331]..[331]: Chromosome 7, SNP identification no. = rs6968614
  misc_feature [331]..[331]: allele = t, in linkage disequilibrium with rs850470, respectively
  misc_feature [331]..[331]: n is a, t, c or g
cgacatgtagggattatgaccattcaaggtgagatttgggtggggacacagccaaaccatatcataccatattcacagatgcagggaattaggatatagacatctttgggggaccataattaagccctcacaataacatggtataaatgacccttcaaaacgttgcttttctttcttatcatgtataatgttgatggatattgttgtctaaatccctatctgcataccagaggacaagataatgacataaataaatacatgtacaccatgtttacaaaagtaataaaataataggcttactatagaaaataagactcataatgcacttttnctttctccttgttatctaatctgaaaaacaaatataattaaaatatttataaaattccatagatttaatttttaaattgagaatgtactttaatatcatctatgccaaatgctatagtatgctttctctttcatttgaagatttatcaacataacttctcagaagtatttttctcgagatatgttatttactatatattattctgatgcatattaatatacatttaacattcagtttttttttaatttggagaagaaggacagaatataatgtaacaatatgaagataaatcaatgatattaataaaattaaggatattgaaatcctatg

SEQ ID NO: 895 - DNA, 661 bp, Homo sapiens
  misc_feature [331]..[331]: Chromosome 7, SNP identification no. = rs12374872
  misc_feature [331]..[331]: allele = t, in linkage disequilibrium with rs850470, respectively
  misc_feature [331]..[331]: n is a, t, c or g
ttgattttcaacatttcaaattgtataatttatgcattgagagctaaatatttttctctgaactttagttgtgctgtaagctttatcttcttattctcctgaagacaatatttctctttttcctcattccactcttagaatttttaactttgactttacagtagtttttcttaatgtgtctaggtgttttcttttcctttctcttgcttagatattacggagtttcttgagtttgtgccacagtgtcctttgttattattggagaagtctcagacattatctattcaaatattgctgtagcccaattctttctctcctctccttctggatntctactctcacgcatgttacacatctccattgcatctcataggcacctcatgcacttaaaaataaattgtctgacttttgtttcctgtttcaatttcagtatttgctactgatatatcttttgttctctaatctcatgttcttcttaataacacataaattgttaattagatgtatacatttttcagttctagaatttatttttgactctatttagtattttcttaatctctgagaaaattctctgtgtttcctactaaaagttttgggacattttcaccaattatatatccaaattatatttcaacccaccctttttctccttttctga

SEQ ID NO: 896 - DNA, 661 bp, Homo sapiens
  misc_feature [331]..[331]: Chromosome 7, SNP identification no. = rs6968911
  misc_feature [331]..[331]: allele = a, in linkage disequilibrium with rs850470, respectively
  misc_feature [331]..[331]: n is a, t, c or g
gaatagaaatcatgagggctaaaattctgcataccacattgggtaaataaaatataccattctcattttaaattatttataatatatttaagagttaaaacataacggtagacaaagatttgtgtctctttctatagttactacctttcttttatgattcattgaaaattgccaattgctatactgtctcaggatatttacctagtattgaacaagagtcttccatttcttaactgcagtcatgaaagtatgtaacgactctcaactgaggtgctgtttttttttttgacaagtagcagaaatccaaatctaagatgtgataatgaatacnaaaatgtaattcacccagcaatcatttagaaggtagaattatttcagggttaaaaattctgtgacttaacagagaccaagaaaccaaggttgatcttttgtccctttaatgatcataatacgatagttactataattattgtatatatttgtggggtttttttgtgatttcacttactaaaatataaacttcaagagaccatgtctgtctccctcatctttgaacctgtagtgactagcataatatctggcacaaagtagtcattaaatacatatttgttgaatgagtgaataaataaacttttaacttttcctttaattctgccaaata

SEQ ID NO: 897 - DNA, 661 bp, Homo sapiens
  misc_feature [331]..[331]: Chromosome 7, SNP identification no. = rs7784182
  misc_feature [331]..[331]: allele = a, in linkage disequilibrium with rs850470, respectively
  misc_feature [331]..[331]: n is a, t, c or g
ttataatatacatatatgtgtttatttaccatatgtgtatatgtagtatatgtaaatacatgtttatgtattcaaaatattgttttgcaattttaaaattaagtatctttgtttattatacttgttttctttcaatattatgtttgtaaatttttattgatcttcatttatgtattagtttattttaacttttactgttatatattattacatatactgtgctttatttgtttattctaatagtgatgaaattttgggttgtttccaattttatcttttttaaaaacaatgcttctatgcatatatttcttttgtgcacatgaagagaganttctttagaaaacatggccaggcatggaatggctgagactcagtgtatgaacatgttcaaatttcctagacatttcttattggtttatctaatttgttgctgcgatttctatgaccacttctagtatatgagggattctattttttctcatattcttgccaaaaatttgcattttcagagtcttaaatttttaggaatcagctaaatgtcaaacagtacattactgctcttttaatttgaatgttcctggttaccaaccatggtccaataatttgaacagggggaataagactcttaactaggcaatatgtagttacaaatgggtataga

SEQ ID NO: 898 - DNA, 661 bp, Homo sapiens
  misc_feature [331]..[331]: Chromosome 7, SNP identification no. = rs10280300
  misc_feature [331]..[331]: allele = g, in linkage disequilibrium with rs850470, respectively
  misc_feature [331]..[331]: n is a, t, c or g
cccccaaatgaagagacatggaattccaacaattgtattcatggcttcctcaaatttagtgacaagactcattgaatattatcttacttaacactaaatggtagagttagcaacccacaagcttgcataaaataattcagaaaaaaggggaggagaaaatatttcatatgtgcatattaaatatattcatattataagcaaggaaaaactatgtaaagtttctattcttttcatttctgtcattgatccaaggccactcttgttaattatcattgccttctgttctcctatatgtcctttgccttaaatctagacctcaacagcttagagntccttacctcatggaaggactgaaaccttaattgctaaagggtctcaatattcaatgattttacttatttcagttactgtagttttctgtggaactttactaatgagaaaggaaatacttatagctactcagagaacttccgacttttcgacatagtcttcccattcccactgttaacagcaacccaatttccccttggtaattgggatcagtcactctagccagtaaagtattcccttattttctaattggtttactggaaaaaggagcacagaatgcttagcaaagagtgtaatattagagtacaataaaaactttgttacatcccct

SEQ ID NO: 899 - DNA, 661 bp, Homo sapiens
  misc_feature [331]..[331]: Chromosome 7, SNP identification no. = rs6964491
  misc_feature [331]..[331]: allele = g, in linkage disequilibrium with rs850470, respectively
  misc_feature [331]..[331]: n is a, t, c or g
ggaagcttatgctggaattgagacatgattcattctagtatacacaaatagatgtgggctgagacacataacccagtgccattttaaggggagtcccaatcccatactcctgctcttacatgacaatttattataaaagtttatgactgaggtcagttatatctgtaagagaggctcagtaaaaaccaggaaatgttgcacaaaacagcacagctcaaactcacaccagccattaggcagaagcttattgtacatgcttgctactaggtagcagaaccagtttgcaagccaaagtaagagaagaaggaccccagtatttgctgtcatggtntagacaatcttattcacaaagccaattgttgtgacctctctgaagaatatggatgcccaaccaccccaaatatggcttgatgtcaacattcatgattctacacatgcacctagaaagtatgaaaaggcttaccgtttacataatgaggctttctggggagaggaggccacatctccatactggtccaatagtacaggttgatttgaattttttttatttatttttattttttattatttttatttttttattttattttgtttttttttccttgagacgaagtctcgctcttgtaccccaggctggagtgcaatggtgcgatcttgggtc

SEQ ID NO: 900 - DNA, 661 bp, Homo sapiens
  misc_feature [331]..[331]: Chromosome 7, SNP identification no. = rs6951319
  misc_feature [331]..[331]: allele = t, in linkage disequilibrium with rs850470, respectively
  misc_feature [331]..[331]: n is a, t, c or g
gctggaattgagacatgattcattctagtatacacaaatagatgtgggctgagacacataacccagtgccattttaaggggagtcccaatcccatactcctgctcttacatgacaatttattataaaagtttatgactgaggtcagttatatctgtaagagaggctcagtaaaaaccaggaaatgttgcacaaaacagcacagctcaaactcacaccagccattaggcagaagcttattgtacatgcttgctactaggtagcagaaccagtttgcaagccaaagtaagagaagaaggaccccagtatttgctgtcatggtgtagacaatcntattcacaaagccaattgttgtgacctctctgaagaatatggatgcccaaccaccccaaatatggcttgatgtcaacattcatgattctacacatgcacctagaaagtatgaaaaggcttaccgtttacataatgaggctttctggggagaggaggccacatctccatactggtccaatagtacaggttgatttgaattttttttatttatttttattttttattatttttatttttttattttattttgtttttttttccttgagacgaagtctcgctcttgtaccccaggctggagtgcaatggtgcgatcttgggtcactgcaacct

SEQ ID NO: 901 - DNA, 661 bp, Homo sapiens
  misc_feature [331]..[331]: Chromosome 7, SNP identification no. = rs1357620
  misc_feature [331]..[331]: allele = t, in linkage disequilibrium with rs850470, respectively
  misc_feature [331]..[331]: n is a, t, c or g
gagttcaaattaataaggtatataaacatccattagtaatttacataaaccaaatctttttgaggagtatgttaaattcgaaaacttttattaatatgaaatttctcgtaaatttgttagaagtataaattaagtatttgtacctttaatgaacgtaaaatactgacttattatactatgcgttttgttggattacaaaaaaggactgagttgtacaccaaaggatgattatttttattagtgagagtaaaagagttatatatgttttgatacactgacgtgttagatttgtgaaacacataatgtgagtagtagtgttggtggtacgttntatcaataataaaaggggtaaaacatctcttctttttattttcaatacactgaacgagtcagtgtttccatttttgactactttcattttaattttggactgcaataaagtattaaaaatttaattcaacataagtgggtaaattgatatgtaacctctttaaaactattaacacgtgactgtaaattaagagtgttgtgtgtttttttctaccttttgtcaaggtaagagtattgggaaacatccggtagaggagagggtcagaggtcggagtccgttggtgggtagactaaagactgggatctatgaaaaagattctcaagtatactt

SEQ ID NO: 902 - DNA, 661 bp, Homo sapiens
  misc_feature [331]..[331]: Chromosome 7, SNP identification no. = rs12531013
  misc_feature [331]..[331]: allele = a, in linkage disequilibrium with rs850470, respectively
  misc_feature [331]..[331]: n is a, t, c or g
tacaaatatatggaataattaaacttgaggatgtgtttgtttttataaagatataactgatgactacactacaccaaggataacaagacaacagggcacaaaaatggagaattaaccttgcattgtattccatagaagcaccatctttaaggtagtaatagcagagttttttttttcctttgttttaggagatgataaggtagtcacactgtttgttacattattttatctaggatcttgcaagtccagtttcagaacaaagtgactaactgtgtctatatcatggaaagcatgcatctttagctaggtgcatccaaagataaactatcantatcctttagaaaagagaaaaattattgcagagtcaaaatgatagtgataaataagtgaccaaaggaaaaagagaatgaagagataggacgttatacattaaactaaatagtagcattataaaatgtgctaaattatttggtccattattcacagtatctgtttccttgctttaaaataagtcatataacagctgtagtaatacataagtctttttacaactgaatacttaaatggatcttaatacttggtgtatgtgagttattcataatattgtctgagagttaaggggaaaccccaggaaatctcctttgattatcctctggggtgg

SEQ ID NO: 903 - DNA, 661 bp, Homo sapiens
  misc_feature [331]..[331]: Chromosome 7, SNP identification no. = rs6952652
  misc_feature [331]..[331]: allele = g, in linkage disequilibrium with rs850470, respectively
  misc_feature [331]..[331]: n is a, t, c or g
tttgtctttttataaactaatgagttcattattattatagttttccatttttttcaaaattgcttattcatgtattctgtaaactttttcttgctttgttttttaataaagtaatgagtttcttatccttatagttttcaatttttaagtttttttcaatctgcaatgccatctctatcttatatcatagagatacatgtgcatcaaaaatatacatcttccagaacatcacttactatgatgacatttattgtgtgatttgtcttctgcacactgtcatcccatagaacacaatgagctgtgccttttgcagtttcctaggctaatgatntttaagtatgttgacaattgggctgagctttaagtaccaaatatagaatcaccatgtgaataaagaggtccaaagaaaaaataagcaacaggattacaataggctgtcaagaaaatgtgagtcctggggacaaatacaatattttttaaagtgagttaatgcatatgcatacaggcacatatacatttcatacacgcacacacacgtgcgtgcacatataaataggtatacataagtatgacacctaacaatgatcatgtatagcacaaacttcaatttttggagtaaaaaataccctgtgatttccaaaaataaaaccttacattttga

SEQ ID NO: 904 - DNA, 661 bp, Homo sapiens
  misc_feature [331]..[331]: Chromosome 7, SNP identification no. = rs16882782
  misc_feature [331]..[331]: allele = a, in linkage disequilibrium with rs850470, respectively
  misc_feature [331]..[331]: n is a, t, c or g
agatgaacttaaagaatacagaaactgcatgtataaggaggagctactacctatagggctgagatagagtatccgaggaagaccccaaccccactcctccactaaaagactgagatcgaactgtattggagagggcctggatttggctcatggatagtggagaggtgccatgctggactccctggtgattgtccctctggactgcacatccctgtggtcatgcattttgaattgtggtagcgtaatatatacatgctttctgcagttagcatttaatctgacttgaaaataaagttgtttgcataatgtagctttgtagtattcagaactncaaaaacaagctcaacagagaaattctacaatgtgctcctaagtatgacctaaaataataaacttacatacatctgtgaagttttaaataataccagtgaatttatacataaaacatacccatataaagctcatatagatgagcgatatattgggaaataactggtgcacaggagcagcaggataaaatgtagagcaaccaagtagatacttattagtatcctttttattacacttattatctgttttgtaacataaaactagtcataaagcagtttatacataatacaacctgatgtgtaatacagaatagcactcatgaaaattcagc

SEQ ID NO: 905 - DNA, 661 bp, Homo sapiens
  misc_feature [331]..[331]: Chromosome 7, SNP identification no. = rs17169751
  misc_feature [331]..[331]: allele = t, in linkage disequilibrium with rs850470, respectively
  misc_feature [331]..[331]: n is a, t, c or g
gagaaattctacaatgtgctcctaagtatgacctaaaataataaacttacatacatctgtgaagttttaaataataccagtgaatttatacataaaacatacccatataaagctcatatagatgagcgatatattgggaaataactggtgcacaggagcagcaggataaaatgtagagcaaccaagtagatacttattagtatcctttttattacacttattatctgttttgtaacataaaactagtcataaagcagtttatacataatacaacctgatgtgtaatacagaatagcactcatgaaaattcagcatcaaaatagaaaccacnggatgcaccttctaagatggtggtgtctggggccagtaggtttatggtggacatgtgagaagttgtcaaatactggatgaattttgaaatagtagggacagaatttgctaatgaagtttgatgcataatgtgaaagcaagagaaatctaggatgactttcagattggggtgtgaaaaattagaagaatatagttacctttgactgagataaaaaagaaaaataagtagggagtatggggtaggagcagggattgaggatttgagctttgcaaatgctcagtttgagatgcgtcctacaaactatgaaagaggcaattgaatacatgtgat

SEQ ID NO: 906 - DNA, 661 bp, Homo sapiens
  misc_feature [331]..[331]: Chromosome 7, SNP identification no. = rs1357624
  misc_feature [331]..[331]: allele = g, in linkage disequilibrium with rs850470, respectively
  misc_feature [331]..[331]: n is a, t, c or g
ttgtggtgttcgtgtgtttggatgaatctaccgatctttctcatgacaaaagatagagtataaggggacgtacggactttattcgaagataatggtttcactaagaccttttaaacactcacagtcaaagaacgccacaccacctataaagtggatctagtataagtataaactatacgaggagaggtttaaattagtgagtaaataatataatttaaacgaaagtaaaaaggagaactaaaacaaaaaaaagagacgtaaaagtggtggtaaatagaacttacatccgaattcgaagggtaaaacgaaatatggacttcaggaagtgaanatcgaccatggagtaactgggatattgaacatgatgtgatttgaagaattctaagacaaaaaatccgtaacatagaaagaaggtttttagaagtcacctaggagttgtgtttgttttactctaggtctatttggtcgttagtaccagacagtgttagtttcaggaagtgaatgagagtaaataagaataaatgataatgaaaagatacactgtgatgtgaaatctgtttaaccaaataaccagaagagtgtaagctaaattacatatctgaaaatacgtacgaaaaagggtacacattataagagtcgtgaaaatggggtagatagttca

SEQ ID NO: 907 - DNA, 661 bp, Homo sapiens
  misc_feature [331]..[331]: Chromosome 7, SNP identification no. = rs1357623
  misc_feature [331]..[331]: allele = t, in linkage disequilibrium with rs850470, respectively
  misc_feature [331]..[331]: n is a, t, c or g
aaaggtacttcaagtgtcttgtggtgttcgtgtgtttggatgaatctaccgatctttctcatgacaaaagatagagtataaggggacgtacggactttattcgaagataatggtttcactaagaccttttaaacactcacagtcaaagaacgccacaccacctataaagtggatctagtataagtataaactatacgaggagaggtttaaattagtgagtaaataatataatttaaacgaaagtaaaaaggagaactaaaacaaaaaaaagagacgtaaaagtggtggtaaatagaacttacatccgaattcgaagggtaaaacgaaatanggacttcaggaagtgaagatcgaccatggagtaactgggatattgaacatgatgtgatttgaagaattctaagacaaaaaatccgtaacatagaaagaaggtttttagaagtcacctaggagttgtgtttgttttactctaggtctatttggtcgttagtaccagacagtgttagtttcaggaagtgaatgagagtaaataagaataaatgataatgaaaagatacactgtgatgtgaaatctgtttaaccaaataaccagaagagtgtaagctaaattacatatctgaaaatacgtacgaaaaagggtacacattataagagtcgtgaa

SEQ ID NO: 908 - DNA, 661 bp, Homo sapiens
  misc_feature [331]..[331]: Chromosome 7, SNP identification no. = rs17169752
  misc_feature [331]..[331]: allele = g, in linkage disequilibrium with rs850470, respectively
  misc_feature [331]..[331]: n is a, t, c or g
tcacctctcctacttcattaaatccttcctcatttttatgtcagaacctcaaagaaagagtcagtagtggccacctgtttctgcacctcttactcctatattcccatgaactgccttcacacttaagccactaccactccactgggatcacactgaccagtgccattgatgacctcattatttaatccatccagtagagtctttccaggtctctattttttatatctgcattgtttgacaacattgacgacttttttttcttaaatattacttattctgttggttttcattgatttcactcagtcgttctcttctggttcattcttcacantatttttgtaagtcattcactcgctgtctacgcttataggttgtggtcttcaaaattattttcattttaatgtttttcttgctctccatacatatttgaagtgggcaatgatattcaacaccatgcagtttattataaaactctaaatggctacgcttgccactttttaccctgtgtattgacctcacatgagcttgatctcttcttgtccttcatctcaaatccaataatatccacttgatcattaaggtttttaaaatttattcccaaaatattttaccagtggtttttgtctcctttcctacatcaccatttcattatcaccactgt

SEQ ID NO: 909 - DNA, 661 bp, Homo sapiens
  misc_feature [331]..[331]: Chromosome 7, SNP identification no. = rs17169763
  misc_feature [331]..[331]: allele = g, in linkage disequilibrium with rs850470, respectively
  misc_feature [331]..[331]: n is a, t, c or g
aaggccaaagtcttcagaaaataaggaatccgctaaagaagagaacaatcaatgacattccaattcctgaaagagctccaaaacgagcttgaacggggaatcacgtttcagggtgacagtgccatttattagacctatcataaagatatgttaaaggcaccttcatttgaaagaggtgtttatgaactggcacacaataacaaaactgtatctccaaagactatacatgcagtgcagcaaatatctgtatatccagaacttattgccagtgttttatgtcaagccactggtagcaacgagattattgagccagtgtatttctatattggcnctgtttttggattccaaagaatatgttaccgcattatttgttacaagttggcttatgagtggaacatggctaacaggaatgcttactgttgcatgcctcatttttaacagggtagatacaacaagaatagaataccccattcctttaagagaaaactgggcactaccatattttgcatgccaagttgctgcccctacaggctatttaaaaagcaactgaaatacttatggagaggagttttgctacttgttgataagtgcttcaacttacatatttatgatgatgtggggtacggccgctatctcctgtttcttcaagcagtctctctat

SEQ ID NO: 910 - DNA, 661 bp, Homo sapiens
  misc_feature [331]..[331]: Chromosome 7, SNP identification no. = rs17169765
  misc_feature [331]..[331]: allele = g, in linkage disequilibrium with rs850470, respectively
  misc_feature [331]..[331]: n is a, t, c or g
tcttcattccattataatattgatctttaatttgaatatgttcaaggtcagaatgtatttctcaaacataacatttaacaaatatgtaatgtgacataattctttactagaaggaattattcctacctttaaacaagtttctgaaagtgtttcatgatttataacagctgaagttttacaataaaaaacgaatttaaatgttagctgaaaatatgtgagatttaaattaaaatagaaattatataaaggtaagtgatttttaaggatatacataaagatatatccagaattttcatgataatgttctcatcatctgctgcttatataagtnaacactttcttagtaatacaaagtgcacaatattattgcattttatattttatgactgtctagtgattagttttttcacttatgcctattactttgatatcaatttgataatgataaaacaataactgttatctatatttttaaatggacatttaaaagagtgttgttcaggtttttagaaaaatattgatattgggtatacaatttattcatgttttctactgaagtattaagtaaaacattaaatctttatcagaataaaaatatgtgctctaaaatgagcaacaatttctggagatagaggcagatgctgttaaacatacctctgca

SEQ ID NO: 911 - DNA, 661 bp, Homo sapiens
  misc_feature [331]..[331]: Chromosome 7, SNP identification no. = rs6960519
  misc_feature [331]..[331]: allele = c, in linkage disequilibrium with rs850470, respectively
  misc_feature [331]..[331]: n is a, t, c or g
cacatttaccttttatcaactaaaaagtcttggagcattggtttatccagtataacatataatagccaaattgccagacattgagcaatcactgtgctcacacaatgggatatttatttgcatgcccagagcctattgggtagttttcagtcagaagcccttctggaaatttttctttgatgttcgtaagtgggcaaaacaaaacaaaaaaaaaaggaataaaagaaaaatctagatgtcagctttcttattttccattgattcaagtgtaagtgattcaagaacttcttctgcaaggctctagaagctcatgtggtgtgaactatcagangagtgctgaagagaagcattttctagtctttggcagagtattggatctgatcaagaatgcgctaaaattccaaatgacagaaaatactactggatgaaacaattctcagaaaaatccttagcccgagaagagaccccagatattatatatgggagtaagaaaatttaatcctagagtaaaggctgtcctggaactgtccaaacaacgcttaaaagcaaacctcaaagggaataagatgatttgcaagtaagttcactacgtgctgaaacaaagcccaacagtccttagagtaataaaaaaaatgccttttgcaacataaaattcataatg

SEQ ID NO: 912 - DNA, 661 bp, Homo sapiens
  misc_feature [331]..[331]: Chromosome 7, SNP identification no. = rs850456
  misc_feature [331]..[331]: allele = a, in linkage disequilibrium with rs850470, respectively
  misc_feature [331]..[331]: n is a, t, c or g
agggtaaggactcccggggtgggaatactgaatcagtggagggtttctgaggtggagaagtatggaagtatcacccctaatccgaagttatatacttaaactcactccctccttccagtgttcgtaagttttatcttagagaagaagggtggagtgtaaaaaaaacagagatgacaaaaccctcctttatatatttctacccgtggatccgtacaacagaaaacaaatgacataaaccatttgacaaaaccctatggtctgtaatacttaaaatacaacgttttccgtaaaaaaaataatgagattcctgacaacccgaaacaaagtcgtncatcacttgaatgaacgtttagtagaataagggaaactccaaacgaaaattcgcaacaaacctgtcaaggtcctgtcggaaatgagatcctaatttaaaagaatgagggtatatattatagaccccagagaagagcccgattcctaaaaagactcttaacaaagtaggtcatcataaaagacagtaaaccttaaaatcgcgtaagaactagtctaggttatgagacggtttctgatcttttacgaagagaagtcgtgagcagactatcaagtgtggtgtactcgaagatctcggaacgtcttcttcaagaacttagtgaatgtgaactta

SEQ ID NO: 913 - DNA, 661 bp, Homo sapiens
  misc_feature [331]..[331]: Chromosome 7, SNP identification no. = rs850455
  misc_feature [331]..[331]: allele = t, in linkage disequilibrium with rs850470, respectively
  misc_feature [331]..[331]: n is a, t, c or g
acgataatgttttatagaatctgacccattcaagatttgttgtatttaaatagtgtcaagacctccgacccttcaggttctagttccttcaccagcacggaccacccccaagtgaaggagtctctagtacggaagaacgaccaccttcccggtcgttcacgggagtccggagaaatattctcatgactagggtaaggactcccggggtgggaatactgaatcagtggagggtttctgaggtggagaagtatggaagtatcacccctaatccgaagttatatacttaaactcactccctccttccagtgttcgtaagttttatcttagagangaagggtggagtgtaaaaaaaacagagatgacaaaaccctcctttatatatttctacccgtggatccgtacaacagaaaacaaatgacataaaccatttgacaaaaccctatggtctgtaatacttaaaatacaacgttttccgtaaaaaaaataatgagattcctgacaacccgaaacaaagtcgtgcatcacttgaatgaacgtttagtagaataagggaaactccaaacgaaaattcgcaacaaacctgtcaaggtcctgtcggaaatgagatcctaatttaaaagaatgagggtatatattatagaccccagagaagagcccgatt

SEQ ID NO: 914 - DNA, 661 bp, Homo sapiens
  misc_feature [331]..[331]: Chromosome 7, SNP identification no. = rs850454
  misc_feature [331]..[331]: allele = a, in linkage disequilibrium with rs850470, respectively
  misc_feature [331]..[331]: n is a, t, c or g
cctacaaacccccaaaataaaacaaaacatcaaaatagagactgaatcagagaagtccgacgataatgttttatagaatctgacccattcaagatttgttgtatttaaatagtgtcaagacctccgacccttcaggttctagttccttcaccagcacggaccacccccaagtgaaggagtctctagtacggaagaacgaccaccttcccggtcgttcacgggagtccggagaaatattctcatgactagggtaaggactcccggggtgggaatactgaatcagtggagggtttctgaggtggagaagtatggaagtatcacccctaatccnaagttatatacttaaactcactccctccttccagtgttcgtaagttttatcttagagaagaagggtggagtgtaaaaaaaacagagatgacaaaaccctcctttatatatttctacccgtggatccgtacaacagaaaacaaatgacataaaccatttgacaaaaccctatggtctgtaatacttaaaatacaacgttttccgtaaaaaaaataatgagattcctgacaacccgaaacaaagtcgtgcatcacttgaatgaacgtttagtagaataagggaaactccaaacgaaaattcgcaacaaacctgtcaaggtcctgtcggaaat

SEQ ID NO: 915 - DNA, 661 bp, Homo sapiens
  misc_feature [331]..[331]: Chromosome 7, SNP identification no. = rs850452
  misc_feature [331]..[331]: allele = a, in linkage disequilibrium with rs850470, respectively
  misc_feature [331]..[331]: n is a, t, c or g
tggaaagtccaagagagaaggattcgtgtcgagagagggagtgatgttgactctttccaagggacgaaaattcttgggtacactattctgttccgggtgggtatattataggagtcaaataaatgtagacgtttcagtaaaacggttcttgttaatatgtataagggttcaagaccgtactccaatggaaacatcccgtcgtaatgagtcgactggtgtggatgagcctgaaaaaggagaaatttttttttttaatttgaatataagtctgtctcccagttgaaagaccactaccaaaatttacttgggatctcgtagaatgatccgggtncgaagagggaagggtcgtcaaaaagagtcggacggggacgaattgagttcataaagttaccttatctagacccttctgtcgtattcaccaacgtatgactctaaacgacaaaaagagaaaagaaatgtctacaaaacttaaaatgtttaaaagtcacgattttaatacgactcctacaaacccccaaaataaaacaaaacatcaaaatagagactgaatcagagaagtccgacgataatgttttatagaatctgacccattcaagatttgttgtatttaaatagtgtcaagacctccgacccttcaggttctagttccttcaccagcacg

SEQ ID NO: 916 - DNA, 661 bp, Homo sapiens
  misc_feature [331]..[331]: Chromosome 7, SNP identification no. = rs850450
  misc_feature [331]..[331]: allele = g, in linkage disequilibrium with rs850470, respectively
  misc_feature [331]..[331]: n is a, t, c or g
tctgaccgaaacaatcaacgggattggttgtcttgtaccgtcatctctatgacatatttaaaattcggattagtaaaaaaactgacagtatactccttctgaccctatcggatgatctaagaaatgattagactatcggtcgtcagtcgtggttagttgtctgtatctactagtagaatatagaagatcggtgtcgactccactgtctatgacatcgaggtacttactgagattcgtttccgtcgttttgttaataggttggctaaggtcatgtttcatgattattaacaacacgattcgatgatgtaaaacctcactgaacattatatcnttgtctactgttccgcatgatcagaggatactagacaatgttcctgcaataccaacatagataaagatgtcgaggtaataccaacctcgattttaagagaagtagactttttccgtatcccaataaaccgacacacattgacgtttcgctgggtaacactgttgtcttcccctgacagtaacattacataagaataaaaataataaatataaaaagatataaaacccttaagacatgaacctaaaattctcgaatatagaactgcatcaactaaccaaagaggtaaaacgaataaaaagtctccgtagtgtcttaacgatgaaatcatta

SEQ ID NO: 917 - DNA, 661 bp, Homo sapiens
  misc_feature [331]..[331]: Chromosome 7, SNP identification no. = rs850505
  misc_feature [331]..[331]: allele = g, in linkage disequilibrium with rs850470, respectively
  misc_feature [331]..[331]: n is a, t, c or g
tcatagagaaagagaaaggagaagtgaatcaatgaaaaatttacgttgatttggaaggatatagttgaaatggttgtgaaggaggttcttgttagagattgagtttccattccaatcgaggtgtaaatagacacaaaaatatcgtgacgtgtgagaaaaatcgtcgtcgataggtcgacacaaatgtataaataactacaataatacaataattacataagggtgaggtactttgataatctatgttttcccggaacagttaaaactcccgaagcacgggtggaaacatagggtctatgtatagaatcacggacaatatactttcattgantaatgtataaaccccttaattttttttctggtactttcacatttccgtaactataattggacatacgaacatttatatttatttgaccctgaaattctttgaaattcttttgaaattcaaaatcaagttcatcaatacctttagactctcctcgtctgaggttaatttgacccgtaactgtgatataagtatatatgtttgttcacttttttattaaagtacaaatcataatttctttttgtttatattgtttatatttctcagtttttacttgtacggtacatatttatatactctattgttttacccctttatttatatattgttatc

SEQ ID NO: 918 - DNA, 661 bp, Homo sapiens
  misc_feature [331]..[331]: Chromosome 7, SNP identification no. = rs850502
  misc_feature [331]..[331]: allele = a, in linkage disequilibrium with rs850470, respectively
  misc_feature [331]..[331]: n is a, t, c or g
gagactggtgttgcggagaagagtaaaagggtttttcttggacgaaggacagaaacgaaccctgagggacttcgtttcaagttcttttcctatgcatacctacatcaagtaaacgtttcctcgttttttacttgtctttatactctttgtttgttatatcctcatgtaatacctcaagtggtgacaccttttgacccagaaatgggatggatgttggaggagtcttaacaggtagcatcctaacttatagatgagaaaaagagttagagatagctgattcccaaagggacccttaacaattgataggatgtaaagttctcatgagttacangaacaggtcgtccgaggtcttctacggacatcgacagtcttttcaggttcgtctttcacttctcacgtgtaaactctgtaacagtcacacttaattcgggttctggtatgtattaagtcgacttcgatacagagttgacctccagtaatgatgtactactttcaacccccgttgtctccgtatgctatttaaaagataagttctttattttctatgtgtataaaatgtacagtaagaataaatttatttcacgaactaattttttattttctttgtttttcgattcggtaatctacccttgaaagaagtaactcaatgtcgttctaaaga

SEQ ID NO: 919 - DNA, 661 bp, Homo sapiens
  misc_feature [331]..[331]: Chromosome 7, SNP identification no. = rs850500
  misc_feature [331]..[331]: allele = c, in linkage disequilibrium with rs850470, respectively
  misc_feature [331]..[331]: n is a, t, c or g
ctctctaatggattaactccacttttatacccgtacgtacataaagtcttttttttttagaacggttagtagagataatacaaaaggacatattgagtcaaaggacagaggtttagttaatagagtttggagactggtgttgcggagaagagtaaaagggtttttcttggacgaaggacagaaacgaaccctgagggacttcgtttcaagttcttttcctatgcatacctacatcaagtaaacgtttcctcgttttttacttgtctttatactctttgtttgttatatcctcatgtaatacctcaagtggtgacaccttttgacccagaantgggatggatgttggaggagtcttaacaggtagcatcctaacttatagatgagaaaaagagttagagatagctgattcccaaagggacccttaacaattgataggatgtaaagttctcatgagttacaggaacaggtcgtccgaggtcttctacggacatcgacagtcttttcaggttcgtctttcacttctcacgtgtaaactctgtaacagtcacacttaattcgggttctggtatgtattaagtcgacttcgatacagagttgacctccagtaatgatgtactactttcaacccccgttgtctccgtatgctatttaaaagataagt

SEQ ID NO: 920 - DNA, 661 bp, Homo sapiens
  misc_feature [331]..[331]: Chromosome 7, SNP identification no. = rs850499
  misc_feature [331]..[331]: allele = c, in linkage disequilibrium with rs850470, respectively
  misc_feature [331]..[331]: n is a, t, c or g
tcaaaataacattttagttgttaatagacaaacataaaattacgtgagtctttgggtgatattctttttgtgtcttcaataattcgtgtacagactatagtctctctaatggattaactccacttttatacccgtacgtacataaagtcttttttttttagaacggttagtagagataatacaaaaggacatattgagtcaaaggacagaggtttagttaatagagtttggagactggtgttgcggagaagagtaaaagggtttttcttggacgaaggacagaaacgaaccctgagggacttcgtttcaagttcttttcctatgcataccnacatcaagtaaacgtttcctcgttttttacttgtctttatactctttgtttgttatatcctcatgtaatacctcaagtggtgacaccttttgacccagaaatgggatggatgttggaggagtcttaacaggtagcatcctaacttatagatgagaaaaagagttagagatagctgattcccaaagggacccttaacaattgataggatgtaaagttctcatgagttacaggaacaggtcgtccgaggtcttctacggacatcgacagtcttttcaggttcgtctttcacttctcacgtgtaaactctgtaacagtcacacttaattcggg

SEQ ID NO: 921 - DNA, 661 bp, Homo sapiens
  misc_feature [331]..[331]: Chromosome 7, SNP identification no. = rs850493
  misc_feature [331]..[331]: allele = a, in linkage disequilibrium with rs850470, respectively
  misc_feature [331]..[331]: n is a, t, c or g
aactactcaaggggaaaaagtttttcgtgagtaaacaaaacttagaaaaagataatgtctttcgtgaccttaaagagaaagaagttgatttaaagaagtggactttcttccatgaatactagtcaaccgtagttacttcgtaggagttctttacattcctttactgttgaccaagagtccaacacagatgtcctcccttatttacctctgttttgtaaggaggggaaccttgtagagtcctggagcagagttacagaatcgagaatgaaccttccggagacacaaacagagattgggggattgttggatcctgggaccaatgtcttctaanaattatctcatgaccttcttaaggtccattatatacttataatgaatcgttcctgttaatttgaaagtttttttacttaaaaaagatgaccacaaaactttaaagttaatttaacgttaattttctatttgttgtattttcgttgaggtgtaaatgttcaagattcgagattgtaacatgtgtattaacacaaccccatacaaaaaagactatttttctcttaccgtaagatgtttagtagtcagaactcatgagtcctttccgtaactctatcagaattcatacttgtataatatcacgattctttatgttattttccggttcgattaa

SEQ ID NO: 922 - DNA, 661 bp, Homo sapiens
  misc_feature [331]..[331]: Chromosome 7, SNP identification no. = rs850492
  misc_feature [331]..[331]: allele = a, in linkage disequilibrium with rs850470, respectively
  misc_feature [331]..[331]: n is a, t, c or g
tttcacggaataacaatgtatgaagtaatgattacctaaaataaccgtttagttggaatctcattaagtaggattttagactaaaaatcatagaccataccccttgtttgttcatttttataacaagaaaccccttatttcgctaacatacaaaattgacaacttgagattcgtaattttatagtcggaaattatacgattataagtagtatttagaggttctttctcgattttatacttcgtgacaggttttaaatcctgtgtcttcgagaaacgcaaccacaaaaataagagtatatctacatgtatgtgaaaatttcctgattacaantctcttgatatgaaaccttttggattagactttttataatgtcgtccctaaaactggacataagtcatctgaaataggtgttcacccagaattccctaggttttacgaggtacagcactataaaggtacgttacaaacaagaaactaaaaagaaactacaggttgtactattgtttgacaccgacaacttgatgtacattgttcatcttccattttgcatatgtgacgtcgtttacgtctcttcttcgttctatgtgttttcagaaactactcaaggggaaaaagtttttcgtgagtaaacaaaacttagaaaaagataatgtctttcgt

SEQ ID NO: 923 - DNA, 661 bp, Homo sapiens
  misc_feature [331]..[331]: Chromosome 7, SNP identification no. = rs850491
  misc_feature [331]..[331]: allele = g, in linkage disequilibrium with rs850470, respectively
  misc_feature [331]..[331]: n is a, t, c or g
tattccccaaagaacaatatttttacttgtttgttccccataccagatactaaaaatcagattttaggatgaattactctaaggttgatttgccaataaaatccattagtaatgaagtatgtaacaataaggcactttgagaacaacttcggatgactactatttaaaaatgaaggcttcatttatcataggtgtcaattaagcatgaatgctgttttatttgggggttagagatacaacacagaagaatcagaaaatatcaatctctcaccaatttctaaaacattcttatatgccagtatgcatgaagatctgccttttctgttttatnagaaaagcccaaatctaatgaatgggaagaaactgaaattggaatattgttaattatgcagtgtgatagcattttaaaaatgtatgatattgagtagaaaagtcaagagtggataatggcactgatgatgtttcataattgtgataatagacatagtcttatgaagcgatcctatggaccaatgttggcatcgtttaaggttttaaataatcagtatgaaatatggatgaaatagtttacgatattgaaaagaactaataagaacaacagccatgtcctaaacgatctcagattactccagtaatatagtctttatgtagtttgataaca

SEQ ID NO: 924 - DNA, 661 bp, Homo sapiens
  misc_feature [331]..[331]: Chromosome 7, SNP identification no. = rs850490
  misc_feature [331]..[331]: allele = t, in linkage disequilibrium with rs850470, respectively
  misc_feature [331]..[331]: n is a, t, c or g
gcccgatcttacgacaaagacgagacgactaatttatgacataaagaggttaagggattgacctgtcacagtaaaaattgtactcatatattaatagttatttcctttattcccactgtaatatctataatttatctgtttttgttgtgttttctgttattttaacttctgttcgtttatattcctcgtagtaaagtgaccaaattacttacgaaagacaaaagtacctttagaacttttatcggggttttaagagatgtcgtaaaattgaaggaatatttttgagttctagacacaaaagagtcgatgtctgattttcacgttttatttnggtcgtcgtgacccttctgtaattgatggtatatctactgatttataatgtttataaagtaattttcatttgactattaaagggtcttttgtaaaatcaaacaacaaaacatacaggaccactaccttaaaaattttagttctaaaggattaaacaaaaaattatcattaaaccaagagtaaaataaaattcttgtggaaggaattcagatattgattttgatacttttcgttagacatatcataaataaaaaactgagttttatttattattttagtattggatggatcattctaagttaggtaaaaatttcgtatcatgtttcagaag

SEQ ID NO: 925 - DNA, 661 bp, Homo sapiens
  misc_feature [331]..[331]: Chromosome 7, SNP identification no. = rs850489
  misc_feature [331]..[331]: allele = g, in linkage disequilibrium with rs850470, respectively
  misc_feature [331]..[331]: n is a, t, c or g
ttttttctttatgttgaaaaaaagaataatgtatgggcattatatccgtagttataaagttgctcatacttaaggtaagagtgatagaatatcagttaaactctatacccctcagagtgtatttagtatcctcctttgtcattatcaggagcccgatcttacgacaaagacgagacgactaatttatgacataaagaggttaagggattgacctgtcacagtaaaaattgtactcatatattaatagttatttcctttattcccactgtaatatctataatttatctgtttttgttgtgttttctgttattttaacttctgttcgtttatnttcctcgtagtaaagtgaccaaattacttacgaaagacaaaagtacctttagaacttttatcggggttttaagagatgtcgtaaaattgaaggaatatttttgagttctagacacaaaagagtcgatgtctgattttcacgttttatttcggtcgtcgtgacccttctgtaattgatggtatatctactgatttataatgtttataaagtaattttcatttgactattaaagggtcttttgtaaaatcaaacaacaaaacatacaggaccactaccttaaaaattttagttctaaaggattaaacaaaaaattatcattaaaccaagagt

SEQ ID NO: 926 - DNA, 661 bp, Homo sapiens
  misc_feature [331]..[331]: Chromosome 7, SNP identification no. = rs850488
  misc_feature [331]..[331]: allele = a, in linkage disequilibrium with rs850470, respectively
  misc_feature [331]..[331]: n is a, t, c or g
tgacaatattcacatatggtttatcatctgttaatttttaacacaaggtaagtttgtggactgtaactcaacacgtaccatatgtagtaataaaacccaacttctccccaatgtgtaattagtgactccgttacgaaaaggtttattctacattgaccttaaaatgagactatatcgaaatattctttatttatttaacttataagaaatttataattttataaactcatcatactaccataaagattcttgtgttaaatatgtcttaaattatttttaatataagtcatatgttaaagagagtatcgtgtacaatttagtgataatttcnataacgatacctttcttcaaattgacgtttgatagtttcttgttttatgttactttaaaaagagattataagtttataaattaggagagcttatcttgacttctttaaaacttcatttaatcaaattgtccaagtataattatacactatttaagtatggtgtttagatcacctatattaggtcatcatctccgttacctatgttagattttgaatggttttaccgtaaaactattattatgtcctttcatgttctcatgagtatatcactgtacgattttttctttatgttgaaaaaaagaataatgtatgggcattatatccgtagtt

SEQ ID NO: 927 - DNA, 661 bp, Homo sapiens
  misc_feature [331]..[331]: Chromosome 7, SNP identification no. = rs850487
  misc_feature [331]..[331]: allele = t, in linkage disequilibrium with rs850470, respectively
  misc_feature [331]..[331]: n is a, t, c or g
aaacgacgaaatgaaggatttaaagacagattatctcaaaaaccagtctgataagagtctgactgaccacaattacgaaaggtttccacctagggtaaaaagtacatgaagaaaaggattctaacgaaggaacaaaaccactgcctataggaggtaattataggattctatatgctctctatttaaaggacacaaaacacacagattttgatagaaaaataaacttgtaatataaaatgattctaaactgtcagatctttagatccaatcttaattggagtcatttttaaagtttccgtaaaaaaggtaacagaaggccatgagttttatnaaaataataataaatagttaaacgttgaaccaaacgaaaagacttttaaaaattgtttctatagaaatagtgaggataagattatgaagtactgtaaaattgagacttaataaaaaataaggaacaaactagaaaagagtaggtatttgagtgaattctgtctgtatgtgactttcctttaagtcctttatactctttaaacttccgtttctcttgatccacaatacattttgttttcactattaaactcgtacttttataaacgacgaatcttcactatctagggttttgtggtgtttctttgttagattacaaggactcctcactaaa

SEQ ID NO: 928 - DNA, 661 bp, Homo sapiens
  misc_feature [331]..[331]: Chromosome 7, SNP identification no. = rs850486
  misc_feature [331]..[331]: allele = a, in linkage disequilibrium with rs850470, respectively
  misc_feature [331]..[331]: n is a, t, c or g
aaaaaaacggaaatttttttacaccttgagaagtttacagttcataatagttttctaaatttcgatttttgggaagaaatgtagaagggttatattcatatatttaaatacctattcagtaactatttataaatggattaaaactgatttataccaaaccacatcatgttttatcaaataatgtaaatataaataaagaatatattgaatcctcaatttgagtcctcaattattgaattagtataaagttatatatttaaagatacttcaattacgaggttgatcggtttgtgacaccaaaaacaaaacaaaacaaaaaccaaatcgtaanaaatttacaaaataaggtttgcaagtttacgtatcgtaataaacgacgaaatgaaggatttaaagacagattatctcaaaaaccagtctgataagagtctgactgaccacaattacgaaaggtttccacctagggtaaaaagtacatgaagaaaaggattctaacgaaggaacaaaaccactgcctataggaggtaattataggattctatatgctctctatttaaaggacacaaaacacacagattttgatagaaaaataaacttgtaatataaaatgattctaaactgtcagatctttagatccaatcttaattggagtcatttttaa

SEQ ID NO: 929 - DNA, 661 bp, Homo sapiens
  misc_feature [331]..[331]: Chromosome 7, SNP identification no. = rs850485
  misc_feature [331]..[331]: allele = g, in linkage disequilibrium with rs850470, respectively
  misc_feature [331]..[331]: n is a, t, c or g
caaagtttataaaattccaaacacaattaaaaaattaactttaattttattctagtcttttctttcacttaataaaacccttatcccgactaatgtttccaaccttttgacgacacacttactatgtttccaaatccaccacgttaaaaactctatatttttttactcctgaaaaaaacggaaatttttttacaccttgagaagtttacagttcataatagttttctaaatttcgatttttgggaagaaatgtagaagggttatattcatatatttaaatacctattcagtaactatttataaatggattaaaactgatttataccaaacnacatcatgttttatcaaataatgtaaatataaataaagaatatattgaatcctcaatttgagtcctcaattattgaattagtataaagttatatatttaaagatacttcaattacgaggttgatcggtttgtgacaccaaaaacaaaacaaaacaaaaaccaaatcgtaagaaatttacaaaataaggtttgcaagtttacgtatcgtaataaacgacgaaatgaaggatttaaagacagattatctcaaaaaccagtctgataagagtctgactgaccacaattacgaaaggtttccacctagggtaaaaagtacatgaagaaaaggat

SEQ ID NO: 930 - DNA, 661 bp, Homo sapiens
  misc_feature [331]..[331]: Chromosome 7, SNP identification no. = rs850483
  misc_feature [331]..[331]: allele = t, in linkage disequilibrium with rs850470, respectively
  misc_feature [331]..[331]: n is a, t, c or g
attataattttatattatccagatatcaataagaattaaaaacgaggtccataaataagtttaaaaattgcagaagtttccagtaaataagttgttcaaattggtgattaccatttttttttatttctttaaatttgttcactttaactagtattttaacaataatttatattaagtgaatctctcgatattgaatacggttaatgtgtaccttcttctgaattcggtagtgattttctattagatatgaacaaaacgtaaatcaagaatttttcttttaaaccagtggaacaaacaaacaaacagaaaaatggtgtaatcctttattggntgttgaatcttccgtctcatcttaacattatcttagtccctgtcactgttgtttatcttcgatacagactgtgtgactatttctcctttttctgtatttttcgtaattatacctattttactaattcttgtatcatttacaaggttcgaataacttaatattacaagatgtccgaagtcataagagcaccaaagtaacacaatataacattttatgaaaagtagcagttttttagtatttaatacaagtcgtaaaaagacataattctctctttgatacgtcgaataaactctttttttaggttttatccgtttaaaactataaaaagtc

SEQ ID NO: 931 - DNA, 661 bp, Homo sapiens
  misc_feature [331]..[331]: Chromosome 7, SNP identification no. = rs850482
  misc_feature [331]..[331]: allele = a, in linkage disequilibrium with rs850470, respectively
  misc_feature [331]..[331]: n is a, t, c or g
gaccatggaacctaaacgagacttaattactttagtcttaaaaaacaccttttccttttccgtaaggataccacaatctcaaagggtgtacttaggttgtgtgtcaatccccaccctttaagaccaagtcatctatataagcttcttacggtctcaacacaattgtattctatttagtcctactcatgatccacccgtcggttcatacaaatggttttttgggaaagttaatgtagggcggtattttcgctgacttctctgtcggtacagaaacgggtactatctggaaaaggaattataattttatattatccagatatcaataagaatnaaaaacgaggtccataaataagtttaaaaattgcagaagtttccagtaaataagttgttcaaattggtgattaccatttttttttatttctttaaatttgttcactttaactagtattttaacaataatttatattaagtgaatctctcgatattgaatacggttaatgtgtaccttcttctgaattcggtagtgattttctattagatatgaacaaaacgtaaatcaagaatttttcttttaaaccagtggaacaaacaaacaaacagaaaaatggtgtaatcctttattggctgttgaatcttccgtctcatcttaacattatcttag

SEQ ID NO: 932 - DNA, 661 bp, Homo sapiens
  misc_feature [331]..[331]: Chromosome 7, SNP identification no. = rs850480
  misc_feature [331]..[331]: allele = c, in linkage disequilibrium with rs850470, respectively
  misc_feature [331]..[331]: n is a, t, c or g
atttgaattggagaggaacatctcttttctgtaacaccaattacattaagttacgttgagtcatactgatacacagtattctgtatcggatattgtaactcagtctgaaacccttccaaaacacggaagggttttgactttgttaatcaatagtctttgttcactacgaaaggtctttaaactatggtctgagggaccgtaaattcacagtcacttctgtgttacggttctacgaagttattagtataacgaaactacaactctaattttgaacttctttaccgactaaccgtggaaagtgtagaatgtaagcacgatctatttactgtgnagtgacactgatgtatagactctgtaaatattttcggaaatccttaaaaaaattggtatttccaaatgtttagtcagaacatttagagaaagtccctaacttaaatatggattggaccttttcaaccatatctcacaagaccattcctctataaagttaaattcttcgtacatgtacccgataattttgtccatatacgtctccgttacgacttactgtgaggtgaggttcgagtaagactatcttaacctgaaacaaaagtgaaaaaagttaatgacttttactacttccgtcacctcaccattcttcaattctgtcccaaaggtaatt

SEQ ID NO: 933 - DNA, 661 bp, Homo sapiens
  misc_feature [331]..[331]: Chromosome 7, SNP identification no. = rs850478
  misc_feature [331]..[331]: allele = c, in linkage disequilibrium with rs850470, respectively
  misc_feature [331]..[331]: n is a, t, c or g
cgataatagtttttcggttttttcattgtttactcctactcctacacctcattttccttgagtacatgtgatagcctcctcccttacatttaatcatatcgttaataccttttctcatacctctaaagaaatttttgatttttatacttatggtaaactacgtcgttagagagacgacatacatatggattatcattcacgtagtcatacagtttctctataaacgtcagagtgcaaataacgccgtgataagtgttagcggttctataccttagttggatttacaggtagtcgtcttcttatttcctttataccatgtatatgtgttacnctataatgcaccggtatttttacttatttcaagacagtgaacgttgttgtttttatcttgacctccagtattgcaattcactttattcggtccgtgtctttctttttatagtgcaaaagtgagtatgcaccctcgattttttttaattagagtaccttcatctctcctcttaccaccaatggtctccaacccttcttacctccacttcctttctacttctctcctaccgttttatgtcaatctatcttctttatttaaaatcagtgtcaattacaccgatgtcaattattgttgaacaagacataaagtttagccgatcttctttcctaa

SEQ ID NO: 934 - DNA, 661 bp, Homo sapiens
  misc_feature [331]..[331]: Chromosome 7, SNP identification no. = rs850476
  misc_feature [331]..[331]: allele = t, in linkage disequilibrium with rs850470, respectively
  misc_feature [331]..[331]: n is a, t, c or g
tttgtataattatacttaaggatactgttggtagagcaaagacttaaggtcaatattctatctattctgtctgtgaagggtactatacaagttatctactttatcacacgacggtagaagttataaagaatgactttgatgaaacaaagtggaagtaccctaagagagtcctgactcattaaaacactgttttcgaccatttaccttcttgattcaaaggtttacttgtaacggtcaaagagacgacaggatgagattacaaataagtttagggttgtataatgtgagaaagattccggcaaaatctttgttcttccgtataatacgtctntatttgttacgacggaattaatttcataagaaagacttgttttttgtttgtttgtttttgttgtggtttttttgcacaaagagacaaaatgtggtctcggaaaaaaaatgaaacaaataaataaataaataaataaataaaaacatttcactctttttccctttcctttgttcgtaatacggagaaacataccgtgttagagtccgactttgtaaaatgctttttcgtcctatcttaaacttcaagatcttaggttaaatgaattttacgagaagatacatcggacaccttacataaagacgcgacgtttttaatagacacggggtctaa

SEQ ID NO: 935 - DNA, 661 bp, Homo sapiens
  misc_feature [331]..[331]: Chromosome 7, SNP identification no. = rs850474
  misc_feature [331]..[331]: allele = g, in linkage disequilibrium with rs850470, respectively
  misc_feature [331]..[331]: n is a, t, c or g
tagtgaaaccgacccgcgccaccgagtacggacattaaggtcgtgaaaccctccggttctgcccgtctagagaactccagtcctcaaactctggtcggaccggttgtatcactttggaacagggatgatttttatgtttattaatcgacccaaaccaccgtgtgtggacattagggtcgaggagtcccccgactccgtcctcttagtgaacttgacccttccgactccaacgtcactcggttctaacggggtgacgtgaggtcgaaaccactgtctctctttgagacagagtttttctttgtttgttttttggtagagaaccattattacngaacttagttatttacagttcttaaacgaaggtcgtctatggaccttaggataagaattataatagttctcttgtacttataagagcatgattatttacaactatttacgatttacttacacttggaaagtaacacagagagaatacaggactagaccttatcaaaagaaagtattgacaagacattgtactgaaatcgggggttaataagaagatgttttatgggtttgtcaccgaagattaggtgtgtgtgttaaagagagagaaaattcttgacgggaactggttgatacagattttgttcgccttaaaacggctaagagataaaga

SEQ ID NO: 936 - DNA, 661 bp, Homo sapiens
  misc_feature [331]..[331]: Chromosome 7, SNP identification no. = rs850472
  misc_feature [331]..[331]: allele = g, in linkage disequilibrium with rs850470, respectively
  misc_feature [331]..[331]: n is a, t, c or g
aaagtcgaaacatacggtagtctattgcacagttgatcagttgagacgatatcataacacttttatcggtgtctgttatacatttatttactgacatcgatacgagattattttgaacttaacgttttgtaaagatgtgacgaccacccttatatttcatcatgttggtgataccttttgtcatacctctaaggaatttcttgattttcatcttgatgataaactaggtcgttagggcgatgacccatagatgggtctccttttcttcaataatgtattttttccatgaacgtgtacgtacaaatatcgtcgtgttaaatgttaaagtttnataccttggtcgggtttacgggtagttatttactcacctatttctttgacaccatatatatggtatcatatatgtgtctccttttcagtacacatacatatacacacacacacacatacatatgtgtgtgtgtgtgtgtgtgtgtgtgtgtgtgtgtatatatatatatactctaccttacgacgagtcggtatttttccttacttaattaccgtaaatgacgttggacctaccctaacctctctgtatttttactatgttacttgaaacccgtgagtccccttttccaccctttagagtgttcaatggtgattttcttgaatgagtaca

SEQ ID NO: 937 - DNA, 661 bp, Homo sapiens
  misc_feature [331]..[331]: Chromosome 7, SNP identification no. = rs850470
  misc_feature [331]..[331]: allele = t, c
  misc_feature [331]..[331]: n is a, t, c or g
acctagaatagttacacgaaatggttttactagtgtccttctgttttctatttgtttctctttacgtgtgtagtcttttcgtctttgtattgtctacttttagttctatttatagatcctgtttccctacggaaaaattaatcttgacttccttttcagacttattttgaatcttataagtccctatacgtatctacacattttacatatctatgcaaatctatacatttcgtgtgtgtgtgttttctgaaatgtcttaaaaactgataaaatttattttaaaggtatctacttgacttttcttccaactgtaacgactctcgtattaatnaccaccagaccttatagttcacgacttatttaacgtatcaagtttaattctctctctccccctccctcctctctctctctgtctctcccttgtactttgtatcactatgtagtacttcctttttgatactttgtttagacttttctcttagtctggttctacttgtatttctcttaaaggtttcccagaaagagtctcaagaggttttcccttttttattttaacctctcttgtccagtttacgacaattggacgaagaaaatcaaaacgaactcagatattattatgtaataaaattgagaaaccctaaccttttgggaatcggttcag

SEQ ID NO: 938 - DNA, 661 bp, Homo sapiens
  misc_feature [331]..[331]: Chromosome 7, SNP identification no. = rs850468
  misc_feature [331]..[331]: allele = g, in linkage disequilibrium with rs850470, respectively
  misc_feature [331]..[331]: n is a, t, c or g
cgtactgagtagttaagatacttgtgattctattccttgacgggaccttctgatctaaaaataaaaaacaaagacttctaccatcctttttaaccgtatagttttaatcactattgggagttctcttctttacaaccacaaaagtggtagaataccggacctagaatagttacacgaaatggttttactagtgtccttctgttttctatttgtttctctttacgtgtgtagtcttttcgtctttgtattgtctacttttagttctatttatagatcctgtttccctacggaaaaattaatcttgacttccttttcagacttattttgaatnttataagtccctatacgtatctacacattttacatatctatgcaaatctatacatttcgtgtgtgtgtgttttctgaaatgtcttaaaaactgataaaatttattttaaaggtatctacttgacttttcttccaactgtaacgactctcgtattaatcaccaccagaccttatagttcacgacttatttaacgtatcaagtttaattctctctctccccctccctcctctctctctctgtctctcccttgtactttgtatcactatgtagtacttcctttttgatactttgtttagacttttctcttagtctggttctacttgtatttct

SEQ ID NO: 939 - DNA, 661 bp, Homo sapiens
  misc_feature [331]..[331]: Chromosome 7, SNP identification no. = rs850467
  misc_feature [331]..[331]: allele = a, in linkage disequilibrium with rs850470, respectively
  misc_feature [331]..[331]: n is a, t, c or g
aagattctttcttttttgagttgtgagaaggtcgggaagaggggtagacagagacttccttgtattctcggatttgactccggtagatgatcaacttatctataaccacgtccccctccagtttccaccaatactcaccgtcttctctccctgacgaataagacctcgagaaaccggtcttgaaagttatgaaaagatgtgtaatcttagttgatccctcgatattcttcatggctacagatccaaggtacagatctttaagactaaagtagcgggaacccatactggactcgtaacctataaaatttcttacggacccaataaaattatncgtttgtttaatctctttgtgacgaattccgtcttccaaatgaaagaattgaggacgtctcagatcatctcttggaacgtttgggaaaaccctttctcaaaatagtcagtggaagtacgactacggagatcgtactgagtagttaagatacttgtgattctattccttgacgggaccttctgatctaaaaataaaaaacaaagacttctaccatcctttttaaccgtatagttttaatcactattgggagttctcttctttacaaccacaaaagtggtagaataccggacctagaatagttacacgaaatggttttactagtgtccttct

SEQ ID NO: 940 - DNA, 661 bp, Homo sapiens
  misc_feature [331]..[331]: Chromosome 7, SNP identification no. = rs850466
  misc_feature [331]..[331]: allele = c, in linkage disequilibrium with rs850470, respectively
  misc_feature [331]..[331]: n is a, t, c or g
caatagaatttactctctttgactcaacgaacggtttttatttaattatttctgtaatacacacagtagaaaatgtccgtcaactctctgtctctcagtctctctctctctccctcttgtagatgccttacagtttaagattctttcttttttgagttgtgagaaggtcgggaagaggggtagacagagacttccttgtattctcggatttgactccggtagatgatcaacttatctataaccacgtccccctccagtttccaccaatactcaccgtcttctctccctgacgaataagacctcgagaaaccggtcttgaaagttatgaaangatgtgtaatcttagttgatccctcgatattcttcatggctacagatccaaggtacagatctttaagactaaagtagcgggaacccatactggactcgtaacctataaaatttcttacggacccaataaaattatgcgtttgtttaatctctttgtgacgaattccgtcttccaaatgaaagaattgaggacgtctcagatcatctcttggaacgtttgggaaaaccctttctcaaaatagtcagtggaagtacgactacggagatcgtactgagtagttaagatacttgtgattctattccttgacgggaccttctgatctaaaaataa

SEQ ID NO: 941 - DNA, 661 bp, Homo sapiens
  misc_feature [331]..[331]: Chromosome 7, SNP identification no. = rs850462
  misc_feature [331]..[331]: allele = a, in linkage disequilibrium with rs850470, respectively
  misc_feature [331]..[331]: n is a, t, c or g
gacattagggttgtgaaaccctccggctccgcccgcctagtgctccagtcctctagctctggtaggactgattgtgccactttggggcagagatgattttcatgttttttattcggcccgcaccaccgcccgcggacatcagggtcgatgagccctccgactccgtcctcttaccgcacttaggccctccacctcgaacgtcactcggctctagcgcggtgacgtgaggtcggacccgctgtctcgctctgaggcagagtttttttatttatttatttttattttttaatttttttttttcgcgtaagatcgaaggtcttattaaagagtnacttatgcatcaagagttttgtttttacattatgaagaagatccgagaagtttcggggtgacctttaataacgtaatacaaatgaacataaaattaaaggttaaatatacttcaatactctgatcttaaaaatgaagaaaattctttacaaaatttattctatcgaattttagttgtttttcattcatttcttcacactaatgatagtaaatcggtaagcagataacttaataaggtatcaaattgtttagttgattgtttgttcgttatatacacagtttctttaacgaaaactatacgtttgtcgtttattatgtatacacatcatcg

SEQ ID NO: 942 - DNA, 661 bp, Homo sapiens
  misc_feature [331]..[331]: Chromosome 7, SNP identification no. = rs850461
  misc_feature [331]..[331]: allele = a, in linkage disequilibrium with rs850470, respectively
  misc_feature [331]..[331]: n is a, t, c or g
taacatccggcccgtgccacctagtgcggacattagggttgtgaaaccctccggctccgcccgcctagtgctccagtcctctagctctggtaggactgattgtgccactttggggcagagatgattttcatgttttttattcggcccgcaccaccgcccgcggacatcagggtcgatgagccctccgactccgtcctcttaccgcacttaggccctccacctcgaacgtcactcggctctagcgcggtgacgtgaggtcggacccgctgtctcgctctgaggcagagtttttttatttatttatttttattttttaatttttttttttcgngtaagatcgaaggtcttattaaagagtgacttatgcatcaagagttttgtttttacattatgaagaagatccgagaagtttcggggtgacctttaataacgtaatacaaatgaacataaaattaaaggttaaatatacttcaatactctgatcttaaaaatgaagaaaattctttacaaaatttattctatcgaattttagttgtttttcattcatttcttcacactaatgatagtaaatcggtaagcagataacttaataaggtatcaaattgtttagttgattgtttgttcgttatatacacagtttctttaacgaaaactatacgtt

SEQ ID NO: 943 - DNA, 661 bp, Homo sapiens
  misc_feature [331]..[331]: Chromosome 7, SNP identification no. = rs850458
  misc_feature [331]..[331]: allele = a, in linkage disequilibrium with rs850470, respectively
  misc_feature [331]..[331]: n is a, t, c or g
actttataggaagtcttttactgacgacttcacttttaaagagagatatattgattctattgagaaatccccagtagatctctttttctattagaccttttctgaacatacgctacatttacaattgatacgaaaataattttttcatcaaaaattagggtcatcttcagtatcttttctttttaccaaaatgaaaagagaaataccattacacccgattgatgttaataaataaaggtaataacaagtttcctctttatctcctctgtctcacttggacctataaagacggaatataatgacacagtcagaacggtcgtgtatactattncctcatagaacacactggtgtaatctcctttttcaattctagtctgggtcataacgcaacaaataagactcacttcacctaggacccgtcaacgatatgtgtgaaaggactgactcccaacgtatagtattgactctttctcgtatcctcgtcatcgtaactttctaacactgcagaccgactgataatacttagtcaaaaacttgcataatcctcagttaacattactgtgttaaatgatttttgaaaagtttcaaatcaaacatatatatattttgatataacatagctaatgtctcatggttagaagttgaattgtgtactgttatt

SEQ ID NO: 944 - DNA, 661 bp, Homo sapiens
  misc_feature [331]..[331]: Chromosome 7, SNP identification no. = rs850457
  misc_feature [331]..[331]: allele = t, in linkage disequilibrium with rs850470, respectively
  misc_feature [331]..[331]: n is a, t, c or g
ttacaaagtccatgacacctctgtaaaagttatccaaatctcccgactactttttactatgaagtttctgtaaagtcgtactttataggaagtcttttactgacgacttcacttttaaagagagatatattgattctattgagaaatccccagtagatctctttttctattagaccttttctgaacatacgctacatttacaattgatacgaaaataattttttcatcaaaaattagggtcatcttcagtatcttttctttttaccaaaatgaaaagagaaataccattacacccgattgatgttaataaataaaggtaataacaagtttnctctttatctcctctgtctcacttggacctataaagacggaatataatgacacagtcagaacggtcgtgtatactattgcctcatagaacacactggtgtaatctcctttttcaattctagtctgggtcataacgcaacaaataagactcacttcacctaggacccgtcaacgatatgtgtgaaaggactgactcccaacgtatagtattgactctttctcgtatcctcgtcatcgtaactttctaacactgcagaccgactgataatacttagtcaaaaacttgcataatcctcagttaacattactgtgttaaatgatttttgaaaag

SEQ ID NO: 945 - DNA, 661 bp, Homo sapiens
  misc_feature [331]..[331]: Chromosome 7, SNP identification no. = rs860333
  misc_feature [331]..[331]: allele = c, in linkage disequilibrium with rs850470, respectively
  misc_feature [331]..[331]: n is a, t, c or g
cgactataacaaatggtttttgttagaatgcaatgaagatttgatttccatgactacaatgagaaaagtaaaaagaaaagacaaaggagaacttacgtgatatatcaaaataagtaaagactgaccgtctttctttaaagttatttaatactaacgatgaaatacttaaaagtcttgtagactcattacattttactatataaagttgtctcttttacaaagtccatgacacctctgtaaaagttatccaaatctcccgactactttttactatgaagtttctgtaaagtcgtactttataggaagtcttttactgacgacttcacttttnaagagagatatattgattctattgagaaatccccagtagatctctttttctattagaccttttctgaacatacgctacatttacaattgatacgaaaataattttttcatcaaaaattagggtcatcttcagtatcttttctttttaccaaaatgaaaagagaaataccattacacccgattgatgttaataaataaaggtaataacaagtttcctctttatctcctctgtctcacttggacctataaagacggaatataatgacacagtcagaacggtcgtgtatactattgcctcatagaacacactggtgtaatctcctttttcaat

SEQ ID NO: 946 - DNA, 661 bp, Homo sapiens
  misc_feature [331]..[331]: Chromosome 7, SNP identification no. = rs10246840
  misc_feature [331]..[331]: allele = a, in linkage disequilibrium with rs850470, respectively
  misc_feature [331]..[331]: n is a, t, c or g
tctggaatggttgattcataattaaacatgactcatattccaccttggcaattttcttccctgcaatcttggattgattcctgttttttattccatgtctttgtctttcttgggttagtgctttctctaccttctccttttcctccttcttcttctttgggctatgtatccttaaatcacttctttagaaaaacagcatgagaagtactttctaaatacaggcatacctcagatatattgggggttgtgtttcaggccaccataattgtgataaactgaatatcacaaaaaggtaagtcatgcaaattttgtggtttcccagtacatatanaagtcctttccccattgcttgttattgttgattttgtcaatgaccagatgattgcaggtgtgtagctttattcatgggttctctgtcctgttccattgatctatgtgtttgtttttgcatcagtaccatgctgttttggttactgtggtcttgtagtatagtttgaaatcaggtagtgtaataccactggctttgttccttttacttagagttgttttggctattcaggctcctttttagttccatatgaattttagaatcctttttttcccccttattctgttaaaaataatgttggtaggttgataggaatagagttgactctaaatt

SEQ ID NO: 947 - DNA, 661 bp, Homo sapiens
  misc_feature [331]..[331]: Chromosome 7, SNP identification no. = rs6952320
  misc_feature [331]..[331]: allele = c, in linkage disequilibrium with rs850470, respectively
  misc_feature [331]..[331]: n is a, t, c or g
tttattcatgggttctctgtcctgttccattgatctatgtgtttgtttttgcatcagtaccatgctgttttggttactgtggtcttgtagtatagtttgaaatcaggtagtgtaataccactggctttgttccttttacttagagttgttttggctattcaggctcctttttagttccatatgaattttagaatcctttttttcccccttattctgttaaaaataatgttggtaggttgataggaatagagttgactctaaattgctttgggccatttgaccatttaaaaaatattgattcttttgatccatgagcagtgtatatttttcnatttgcttgtatcatctatgatttatttcagcagtgttttataattctccttgtagagatctttcacctccttggttagatgtatgccaaggatatgtgtgtggctattgttggtgtgattgtattgttgatttgattctcatcttgaatattattggtgtatagaaatgcaactgataattgtatgttgattttgtattctgaaatgttattgaaattgtttatcagatccaggaacattttggtgaaaactttagggttttctaggtatagaatcatatcagtgaagaatgataatttgagttcttcctttcttatttggatgccttt

SEQ ID NO: 948 - DNA, 661 bp, Homo sapiens
  misc_feature [331]..[331]: Chromosome 7, SNP identification no. = rs1079789
  misc_feature [331]..[331]: allele = t, in linkage disequilibrium with rs850470, respectively
  misc_feature [331]..[331]: n is a, t, c or g
gaattttccgtgtttcactttgtaacctattcttttgatctgggtaggtagacgacagaagttctttggttcgagtgtaaaaaaaaaagtagacgtgtaccatgtatgagattctgactggtgtacgaaacgacattttgttcagagtcttttaagttttatataagtatggatgatataaaactttggtgtcaccttatttttatgtttagttatggtcctagagaattttgatattattgtacctttaatgtgttgaacgagtaaactcatttgttgttttaattccgtcttttaaaaaattattgaatctttatttatttttgtctcnttgtggatgtctttagagaccctgtgtcgattacgtcacaatgctcctttcaaatatcgtgacttacggataaagttcttcaatctttatggattttaatcgttagattacctccttaccctttgtgttcttgtttggttagtgtttcgatcgtctcatattcttagttggttttagtctcgtcttgacttactctaactctagggttttatgtatttttcgtagttacttcggttttcgaaaaacaaattttcttagttgttttaactatctagtgattcatctaattcttttttctgtcttctaggtttattcgtgttaatctttact

SEQ ID NO: 949 - DNA, 661 bp, Homo sapiens
  misc_feature [331]..[331]: Chromosome 7, SNP identification no. = rs10952623
  misc_feature [331]..[331]: allele = a, in linkage disequilibrium with rs850470, respectively
  misc_feature [331]..[331]: n is a, t, c or g
tcttgtaagactggtttagtggtaatgaattcctttagtgattgcctgtctgaaaaagattttatttctccttcacttatgaagcttagtttggcagggtatgaaattcatggttgaagttctttgaggatgcagaaaataggtcccccaaaaggtcttctggcttgcagggtttctgctgagaagtatgctgttagcctgatggggttccctttttatgcagtctgatctttttctctagctgcttttaagattttttaaaatttcattttgaccttagacagctgagtgactacatgctttggtgatgtttgttttgtatagtatctantaagcgttatctgaatttcttgtatctgggtgtctacctctccagcaaagttaggaaaatttttaaaaattattctctcaagtacattttttggattgcttactttttatcttgctctctccctgtagtgccaataattcttaggtttggttgctttacataatcccatatttcctggataccttgttcaagttttaaaattcttagttctttatttttttctgactggtttagtttgaaagacaattttcaatttctaaaattctttattctgcttgatttagtctattgataaaactttcaattgcattttgaagttccttaagcgag

SEQ ID NO: 950 - DNA, 661 bp, Homo sapiens
  misc_feature [331]..[331]: Chromosome 7, SNP identification no. = rs1468582
  misc_feature [331]..[331]: allele = c, in linkage disequilibrium with rs850470, respectively
  misc_feature [331]..[331]: n is a, t, c or g
gtgtcggtcgaggacttgaaccccgatcggactggggttaggtcggggaaatactgagtatgtacgacaggtcgttcggtacatcctcggacccttgacctcttgatggatggggtaggattcagacgaccgtggactggtgtaaagagtcccggactccaatctggttgggttcgtcgactgtggtggtgttggttgtgggtaagtgtacccaggtttccacctagggggagggacgtgaagtgtttttcgttgtcatgacggtgtaacctcttgtccactctaaatttggatagacatagctcaactcactactctaatacaagatttnagtgagggtgtctctcgacgttttatccgtaaaggacaccgagagttagtggaatacccggtctctatctgatattacacacagacttgaccctcaatactcggaactttgtttccacactatccctttgtctaacataacgacggatagatcttatccttcggtcacgtcggaggagtgaggaggacgtctctggagtcgtgtaaagtggtcctcgagtgggggtcagtgggaacaatcccgaccacggacgtaagaggtaaccctataagtacccgtttggtccccgaggtcgagggattggtggtgggggtaccctgtccttcgagt

SEQ ID NO: 951 - DNA, 661 bp, Homo sapiens
  misc_feature [331]..[331]: Chromosome 7, SNP identification no. = rs2372057
  misc_feature [331]..[331]: allele = a, in linkage disequilibrium with rs850470, respectively
  misc_feature [331]..[331]: n is a, t, c or g
taaagagtttctttgagcataacgtcaattcacaaactgggcagcactagagcacaagtgggtcagggctcccctgaaagtgcacaaggggaaaaattgtacaaagtgttctcaaaagccagacagagaaaatatttgattggttaaagtggaacagtagccttcttcagttagatgttaattgaaagtttctgattggttaagctactccaagttgggtttttgtttgtttacctaggagcacagaacactggagctgtctcgaccttatgggttccaattaattttttaaaaagttttaaagcttattttctgcactgaatcatcttcntttccttcaaattattgcttactttcctttttctgtcccctaatattttaacctcaatcattttcttttacattccaggcttttgttaagtatactgtgattattcatttcaacttcttcattttatgttactttagttttagagcaaataaataatagagttggtcagaatctctctaaatgcaggcttgttttgagacatgaaaagctttgtcttatctgagtgatgagagacctataatttggcagaatgagaagggcttcactctgtggtgcaatcgtccatagttatttgccatagtcttttttgacaacttacttttctttaaa

SEQ ID NO: 952 - DNA, 661 bp, Homo sapiens
  misc_feature [331]..[331]: Chromosome 7, SNP identification no. = rs10952624
  misc_feature [331]..[331]: allele = t, in linkage disequilibrium with rs850470, respectively
  misc_feature [331]..[331]: n is a, t, c or g
ttcaacttcttcattttatgttactttagttttagagcaaataaataatagagttggtcagaatctctctaaatgcaggcttgttttgagacatgaaaagctttgtcttatctgagtgatgagagacctataatttggcagaatgagaagggcttcactctgtggtgcaatcgtccatagttatttgccatagtcttttttgacaacttacttttctttaaacagagaaaaaagactcaggttctttgcctgggattaaacactttgcataatttgactatggatagggaataatgtcataaagtcaacttcctatatatggaatgtcaanctcactctttttcacagctattttttacctattttaagccctattgctataaaagttaggaaagttctcagggacatgagttctacctgactggtaaggggctcacaagattttaatctgtaagatacagatgtgtgtgtgtatatatatacacatatatacatatatatgtgtatgtatatgtatatatgtgtatatgtgtatgtgtgtgtgtatgtgtgtgtatatatatatttgtatattccagctgccccaggtattctttattttatttactttctcgaaggttgctaaagaacttcctgttttactttgccatttacatttatg

SEQ ID NO: 953 - DNA, 661 bp, Homo sapiens
  misc_feature [331]..[331]: Chromosome 7, SNP identification no. = rs733171
  misc_feature [331]..[331]: allele = g, in linkage disequilibrium with rs850470, respectively
  misc_feature [331]..[331]: n is a, t, c or g
tgtcatgattacatttaaccgtgtgtgaaatctctcgataaattactatacctagattttactcacaacacaagaaatggaaccggttaatgaaattaacttgtaatatttgtctaaatttcttcaaacgtttcttggtctgtactcaatcagtgaacatttaaaatatatcatcattttttatataaatttttataataaatggtatcccctgatcaatttgtttactacctcttaggtagattattctagacaaagaacgtatagtaagttcgaattattatcttatgacagtaaaggtctatcggtagaataaaataaaaactctttnacagtacaattttaaatattaaagattgtacgtgtctatgattcgtaactttttctccatccttatagccttgttaagattgccaaaaagtagggaacgagtctttactgtcttttacaacactattattattgttccgattcttgtatatacctcaatacggtatgaatacggtagtaattaaatatattatgaaattgttataagactacaaccatgtacgtaagaattgacacagtatctcattttttacaccgataaatcatattatagttaacacacatttaacctaccttgacctaattatctctttatttttgtcaactttta

SEQ ID NO: 954 - DNA, 661 bp, Homo sapiens
  misc_feature [331]..[331]: Chromosome 7, SNP identification no. = rs10952625
  misc_feature [331]..[331]: allele = c, in linkage disequilibrium with rs850470, respectively
  misc_feature [331]..[331]: n is a, t, c or g
gcaaacttctttaaatctgtttataatgttcaattaaagtaattggccaaggtaaagaacacaacactcattttagatccatatcattaaatagctctctaaagtgtgtgccaatttacattagtactgtgaatgaatgaattctctctaacactattaaacatattttttcaatgtcaacaatttaggaggtgataaatggcatctagttttactttagatttctccaagtatgatgaaaatttgatatggtttcatatgtttattagctatttttaagagaagaggcgtgactgtctcagctgttcttcattttcatcccaaagagctnaggttgtcctcctgctctgaaattgcttgtgtctcctttgcatattctgcttcttttttccttcgtcccatctgctttggattctcctgtaacatgattccatctgttttccttaaaagttcaagtgcattggttgttactatttgttgttttatggcacatttaaaaaatatatgtcttcattacattggctgttgcagggactagataagctaacacaagcagagatttgaaacattgcctgactcacaggcacagatcaaagcttggtagagtatttctttttttgtaatttttttctgtgagcaccttattcatatgttgattacc

SEQ ID NO: 955 - DNA, 661 bp, Homo sapiens
  misc_feature [331]..[331]: Chromosome 7, SNP identification no. = rs12667814
  misc_feature [331]..[331]: allele = a, in linkage disequilibrium with rs850470, respectively
  misc_feature [331]..[331]: n is a, t, c or g
cttattcatatgttgattaccatatcatacagagttaaagttatttcttttctatttgtaaacagctgcactttattaagaaaattattgtcgtatgtgctacctttttatgtttttcttcagatatgaatgtttatatgctcaaattgcactttattttctttagagtttttacttatgcaatatttaaaaatgtctcaaatagagattttttttccataaaaagtagatatatgcatgtaaataagtgaaaaaaataaagaaaagaaaaattgagaaatgctaaggataaaattttaaaaagagaataataataaaagtagaaaaaaancaaaaaatttgttgagctaaagtataaaatggatatgaaaaataaggaattgaaaaatggaaaagaaatacaataattaaaattagggcagatggaaaaaatcagaggacaacaaatgaaaaaacaatacaataaaattaaatgtgactcaagaaatgaaaagaaaaagtatgttgctcctctgtagccattacaatcaaattctttgttcaatatatctagtgttattgtcaacaatacaccaggtagaatatccgactttcacactcagatcgtgtaccaggaacttcattgctcctcaacaaaaccaggaacatatccacgtttaag

SEQ ID NO: 956 - DNA, 661 bp, Homo sapiens
  misc_feature [331]..[331]: Chromosome 7, SNP identification no. = rs6976909
  misc_feature [331]..[331]: allele = c, in linkage disequilibrium with rs850470, respectively
  misc_feature [331]..[331]: n is a, t, c or g
tgcatattaatgtttccagttgggtaacctcaggcaggttgtttaatgtccaagtggctcagttttctcatccataacaacttcatagagacacaaagatagaaatagataatatattaagtatatatttaatatgcctactatcacatagctaacattggctagtcttataacacaatagaatttataaagtccatgcaataccaaccataattccattaagtagtagttatttttctcctaactctcattcttcacagatttaacttcctatgaagaaggaaatttagactaattttctttaaatttgcatattaaaattttctctaanaatcaagatttcatgattagaattataattaaatttctgtgaagtacagggagatgctttcccattttttaaaatcctacttccttgcttgacaaattagtaattgtagtacagagagaatactgagattccccaagtctcaaagctgcttcgtaagtccctgcattcattcaaccagtgtgtgtggactcagtactatcagctgtggtaatgtgctgggtgttaggaacacaatatactttcttcttccattttacttaaagtctagtggaaaagtagggcaaccaggtatataaaactacatccataggctcccgttgataaattctg

SEQ ID NO: 957 - DNA, 661 bp, Homo sapiens
  misc_feature [331]..[331]: Chromosome 7, SNP identification no. = rs2079830
  misc_feature [331]..[331]: allele = g, in linkage disequilibrium with rs850470, respectively
  misc_feature [331]..[331]: n is a, t, c or g
attaaagaatccatgtttattagtgaaaggggtatgcttagaagacttccttaagaatattttaattagacttttaatgtctgtatttttcgattactttaatttcgttaaaggattatgagtcctaataatgagtaacaattttactatcctactattactattttacttggaggtactttttataaatttacgtataatacttctccaccccattctgagtaacagtgtagaatgttctacgttgttctacgtcgaaagcggttaaaggagatggaaaaaaaaaaattatatgaaattcaagaccccatgtacacatcttgcacatcanaacaatgtatccatatgcgcacggtaccaccaaacgacgtggggagttgggtagtggatataatccataaagaggattacgatagggagaggatcgggggataggaggctgtgcggggccacacactacaaggggtgggacacaggtacacaagagtaacaagttgagggtgaatactcactcttgcacgtcataaaccaaaagacaagaacacaatcaaacgactcttactaccaaaggtcgaagtaggtacaggtacgtttcctgtacttgagtaggtaaaaaataccgacgtgtcataaggtaccacatatacacccgtttcctata

SEQ ID NO: 958 - DNA, 661 bp, Homo sapiens
  misc_feature [331]..[331]: Chromosome 7, SNP identification no. = rs12154287
  misc_feature [331]..[331]: allele = t, in linkage disequilibrium with rs850470, respectively
  misc_feature [331]..[331]: n is a, t, c or g
atttccatttattttatattagattaggctatagagagttcttagaatttactgggtaaattgtatacataaattgcaaagcattgaaattgttacttatattccaaaactcatttgtatatttcattcagtcacatattcaagtacatattttgttttgtttttgagactagtatttgttttttcctttttattagtttattctgttataaactttaattttagtgatgatgataaaatacatgcaatgtattttaatgcttttaatgacagaaatgaattaagggcaatttttggatcgaactgtaatttaatttaatttcacagtaantaaagcagttttaaaaaaatatttaggatttgtgtgtatatacaattttttgatattttgcatatttggcaatgatgataaataaattagtctatattttgaagtacacatttttaattatctattaattaatatacgtggcaggaacccagatcatgctcagtctttaagtatcttttgggaacaaacaaatgcgaagaaataagaaggtgaaagatgaaaaggctattatttatggacattctagtaattattttcttgaagcaaaaaactcattcagaaaaaattaacatacagaaaaagaaaaccctgaaaaatagcaggaaggac

SEQ ID NO: 959 - DNA, 661 bp, Homo sapiens
  misc_feature [331]..[331]: Chromosome 7, SNP identification no. = rs1990347
  misc_feature [331]..[331]: allele = t, in linkage disequilibrium with rs850470, respectively
  misc_feature [331]..[331]: n is a, t, c or g
atcaaaagaaaaaaaaaaaaaaaaaaatgaaagatgtaaaaggtcttccgtacttttacaccttgacttatttttttcttttgatttttaaaagaggaaataatattctttttacgtgtaatttgatgtatcataaaaagtagatgaagtgacattatgtcttcaacctactacgtaagacaaatgttctgacttacctttgtttttgtatgaatgtaacgaccatcctcacctttcctgtcatagggtttaccaacctttaaccgttatacatcgtcttagtcaacaccggtattgaactagatgtgtagtcagttgattataatgttgntacgacgaattgttattcttacgttttgaatcgttaaatttcgttacttgtaaataaaaagagtaaataaataaataaaaagagtgtcatacacgtaaccgacaccgaaaatgtagaaattcgacaactaaaagagtcaaatcgtgtccgacatataactcaaatatagacgagatactcacgaagtcaaaagtaattgattttggatgggttccgtataagagtacctcttagtggttagtgtccactgttcgatttaatacattaaggtaaatttcgaagacgaatgtattagagacgagtgtaaggtaactagtttcgtttagtgtc

SEQ ID NO: 960 - DNA, 661 bp, Homo sapiens
  misc_feature [331]..[331]: Chromosome 7, SNP identification no. = rs10267840
  misc_feature [331]..[331]: allele = t, in linkage disequilibrium with rs850470, respectively
  misc_feature [331]..[331]: n is a, t, c or g
atgtccagaaagtgagcaactctttgatattttacctcctagttaatatttagaaatctttatcaacgttcaaatattattcactactgtatatactcaacaacagaatttttctaatgaatatatttattttctacagccaggcattataatctttaagggcaaataactaggataaaaaagccgaatttctcattatttgcatttttccctagattttacattttggaatcaacaatgaagaattacaattacacacatcaaattttttataagatttaatataaactcattttgatgagcactaatgaagttagcaatggctagcacnctctcaatatgttccagatgtctttaagtttgctacctgtattcatttaatcctgaaaagactactatctcttttttacaagtgagaaaaggatgcctcatgaattaaagttcctgggaacacatagaatgaggtagagttggaagtgaagcagataatttaacaacatagcctgtgttccttatagtactacaataaagacaagtcagaaaatgtatttcctacctcataactagtcagggaagaatacaatggagaaaatcggtagaaccaagacacagaatatagacttgaataaaagcaagagttaaactgtttttaaattttaag

SEQ ID NO: 961 - DNA, 661 bp, Homo sapiens
  misc_feature [331]..[331]: Chromosome 7, SNP identification no. = rs10808035
  misc_feature [331]..[331]: allele = g, in linkage disequilibrium with rs850470, respectively
  misc_feature [331]..[331]: n is a, t, c or g
acattagacagatcaatgagacagaaagttaacaaggatatccaggaattgaactcagctctgcaccaagcagacctaatagacatctacagaactctccaccccaaatcaacaaaatatacattcttcttagcaccacatcacacttattccaaaactgaccacatagttggaagttaagcactcctcagcaaatgtaaaagaacagaaattataacaaactatctcttagaacacagtgcaatcaaactagaactcaggattaagaaactcactcaaaaccactcaactacatggaagctgaacaacctgctcctgaatgactactagntacatgatgaaatgaaggcagcaataaagatgttctttgaaaccaatgagaacaaagacacaacatactagaatatctggacatatttaaagcagtgtgtagagggaaatttatagcactaaatgcccacaagagaaagcaggaaagatctaaaattgacaccctaacatcacaattaaaagaactatagaagcaagtgcaaacacattcaaaagctagcagaaggcaagaaataactaagatcagagcagaactgaaggagagagagacacaaaaaaacccttcaaaaaatcagtgaatacatatgtaactaacctgcatgttgtgcat

SEQ ID NO: 962 - DNA, 661 bp, Homo sapiens
  misc_feature [331]..[331]: Chromosome 7, SNP identification no. = rs11763425
  misc_feature [331]..[331]: allele = a, in linkage disequilibrium with rs850470, respectively
  misc_feature [331]..[331]: n is a, t, c or g
aacgcttggacacccagcctgtcgtggggtggggggagggatgagggatagcattaggagacatacctaatgtaaatgatgagttaatgggtgtagcatgccaacatggcacatgtatacatgtgtaacaaacctgcatgttgtgcatatgtaccctagaacttaaaatataaaaaataatagaatcgtagaacaatttacagaagaaaatctttgcagtctaaagaactaaaaaaaaaaaaaaaaaaaaaaaaaacaagtattttccttagaagaacagagatacaaatacctgttgctgaggaatgaagagcagttgaaggaagtcttnttgaatacactcgaattttcttaaaaaataggtatgagtgagtgacgccattaggaagagaagaaacaaagcttacatccagtgacaacaaagcaaaattaacaagacgtcaataacattgaggggcacacaaacacattcactgagagcccagagaaaagttagagccaaaggtgatttgcataaaaatatattggagtgattggagccaatcggtatcattataaaactgtatttttcagagtgcccaagctcaaagtaggaaagagacagaagcaagtttatttaccactgtctagggactggcaagattggtgcagataagataat

SEQ ID NO: 963 - DNA, 661 bp, Homo sapiens
  misc_feature [331]..[331]: Chromosome 7, SNP identification no. = rs2191275
  misc_feature [331]..[331]: allele = t, in linkage disequilibrium with rs850470, respectively
  misc_feature [331]..[331]: n is a, t, c or g
tctcttctttgatgaaatgttatagaccgggatggttcaagtaatgattccaaagaaaccgacatttgaaaatttataatttacgaaatgtataatagaatagacgtggttagaacggtcagggatctgtcaccatttatttgaacgaagacagagaaaggatgaaactcgaacccgtgagactttttatgtcaaaatattactatggctaaccgaggttagtgaggttatataaaaatacgtttagtggaaaccgagattgaaaagagacccgagagtcacttacacaaacacacggggagttacaataactgcagaacaattaaaacgnaacaacagtgacctacattcgaaacaaagaagagaaggattaccgcagtgagtgagtatggataaaaaattcttttaagctcacataagtttttctgaaggaagttgacgagaagtaaggagtcgttgtccataaacatagagacaagaagattccttttatgaacaaaaaaaaaaaaaaaaaaaaaaaaaatcaagaaatctgacgtttctaaaagaagacatttaacaagatgctaagataataaaaaatataaaattcaagatcccatgtatacgtgttgtacgtccaaacaatgtgtacatatgtacacggtacaaccgtacgatg

SEQ ID NO: 964 - DNA, 661 bp, Homo sapiens
  misc_feature [331]..[331]: Chromosome 7, SNP identification no. = rs12535408
  misc_feature [331]..[331]: allele = a, in linkage disequilibrium with rs850470, respectively
  misc_feature [331]..[331]: n is a, t, c or g
ggactggcaagattggtgcagataagataatatgtaaagcatttaatatttaaaagtttacagccaaagaaaccttagtaatgaacttggtagggccagatattgtaaagtagtttcttctctcatttactgtgaggaagcatttaatgataaaaacgtcttcaaattatcatttttaaatacttaagttatagaaaaatgtaggcaattcaaaatgaaacatgccaatgaacctaagaacaaacacagctggaatacttttgggcttttgtaaaattggaattatatctgtttcttgtttttatcttatccaattaatatatttaggagntcaggatttggcatggttctggaaaaagtgttgccttctgggatatagaacagagtgcacaggcagtttggaccacagagatatagctggcagcatcaagctgccttattaaattaagtttcttctaccttttttctaccactgaagatagaggctcaagagttatgttgcaagaggttggactttgtgaaaggctactaaaagctcttttgtttatgaaagatattttggctgattcaacttttttgacatggtttgcattccatagttgagaaggaaaacatgtggtctttaaaatcttccagaaatctgttggcaaagtctgtctta

SEQ ID NO: 965 - DNA, 661 bp, Homo sapiens
  misc_feature [331]..[331]: Chromosome 7, SNP identification no. = rs6961951
  misc_feature [331]..[331]: allele = g, in linkage disequilibrium with rs850470, respectively
  misc_feature [331]..[331]: n is a, t, c or g
caatgaacctaagaacaaacacagctggaatacttttgggcttttgtaaaattggaattatatctgtttcttgtttttatcttatccaattaatatatttaggaggtcaggatttggcatggttctggaaaaagtgttgccttctgggatatagaacagagtgcacaggcagtttggaccacagagatatagctggcagcatcaagctgccttattaaattaagtttcttctaccttttttctaccactgaagatagaggctcaagagttatgttgcaagaggttggactttgtgaaaggctactaaaagctcttttgtttatgaaagatnttttggctgattcaacttttttgacatggtttgcattccatagttgagaaggaaaacatgtggtctttaaaatcttccagaaatctgttggcaaagtctgtcttaattattcttacccccgatttttatatcagcactgttgtagttagagtgcaggcaatgggtattgcaaaacactaacaaataaaattaaaagagacaatatttcagcataattagtgagagcagattgaattttaatcatcttgcccaagctaagtggagaagcaagtgaattttcaaaaggacttgcagaaggaaaaaatggtgatgatgccaagaaaaatgaag

SEQ ID NO: 966 - DNA, 661 bp, Homo sapiens
  misc_feature [331]..[331]: Chromosome 7, SNP identification no. = rs6962101
  misc_feature [331]..[331]: allele = c, in linkage disequilibrium with rs850470, respectively
  misc_feature [331]..[331]: n is a, t, c or g
ttatccaattaatatatttaggaggtcaggatttggcatggttctggaaaaagtgttgccttctgggatatagaacagagtgcacaggcagtttggaccacagagatatagctggcagcatcaagctgccttattaaattaagtttcttctaccttttttctaccactgaagatagaggctcaagagttatgttgcaagaggttggactttgtgaaaggctactaaaagctcttttgtttatgaaagatattttggctgattcaacttttttgacatggtttgcattccatagttgagaaggaaaacatgtggtctttaaaatcttccagnaatctgttggcaaagtctgtcttaattattcttacccccgatttttatatcagcactgttgtagttagagtgcaggcaatgggtattgcaaaacactaacaaataaaattaaaagagacaatatttcagcataattagtgagagcagattgaattttaatcatcttgcccaagctaagtggagaagcaagtgaattttcaaaaggacttgcagaaggaaaaaatggtgatgatgccaagaaaaatgaagccgcggtgaatggaaaagaatagagttcagtctttgaggagcataaaacttaggctctaggggattatggctaaagttaag

SEQ ID NO: 967 - DNA, 661 bp, Homo sapiens
  misc_feature [331]..[331]: Chromosome 7, SNP identification no. = rs6979892
  misc_feature [331]..[331]: allele = c, in linkage disequilibrium with rs850470, respectively
  misc_feature [331]..[331]: n is a, t, c or g
ggtctttaaaatcttccagaaatctgttggcaaagtctgtcttaattattcttacccccgatttttatatcagcactgttgtagttagagtgcaggcaatgggtattgcaaaacactaacaaataaaattaaaagagacaatatttcagcataattagtgagagcagattgaattttaatcatcttgcccaagctaagtggagaagcaagtgaattttcaaaaggacttgcagaaggaaaaaatggtgatgatgccaagaaaaatgaagccgcggtgaatggaaaagaatagagttcagtctttgaggagcataaaacttaggctctaggngattatggctaaagttaagggttcaacatgagacagtggcatcagagtacattagagtttaaatgctcttaaggggctacctagtccatttatcaatgtattagaaaattatctctaaacaaatgacagtctaaacttttattaatacctcaaaagatgcaaacaactgatggtaaagcttattccacagatttccaactctaattgttgaggacctagtgcctccttatactaaaccatatttgtttttgtataacttgcaataactgaatctaattttattttctggaccagcctaaaatacattattcttttcctcatattgtaaaa

SEQ ID NO: 968 - DNA, 661 bp, Homo sapiens
  misc_feature [331]..[331]: Chromosome 7, SNP identification no. = rs12703731
  misc_feature [331]..[331]: allele = t, in linkage disequilibrium with rs850470, respectively
  misc_feature [331]..[331]: n is a, t, c or g
tattaatacctcaaaagatgcaaacaactgatggtaaagcttattccacagatttccaactctaattgttgaggacctagtgcctccttatactaaaccatatttgtttttgtataacttgcaataactgaatctaattttattttctggaccagcctaaaatacattattcttttcctcatattgtaaaaatttaagtgattttagagatcattttcttccttcaagtattcttttttcatgagttttctcatttcttcaagtatttttcaattacatcattacaaacaacctcgcttaatttattctcttctgtattttctatatttgncatcaattcctaaaatcctataagcctaaacatttaaaatatgatctaggaagtaccaagaagagtgacaattatttctcctcttatatgtaataccatcttcaaagtgatctaagttctatttgtatcatttatttaatattttgacccaaacatgcagtgaactaaattccctaagttatgttttccatacatcagtctttgccatctcgcatttgaaatttaccttcatatccctattaaatttcatagtatttctatttttatctgtcttctctgttttgctatccttcccaacttcgcgtcatttaaaaattagttaagtgtaaa

SEQ ID NO: 969 - DNA, 661 bp, Homo sapiens
  misc_feature [331]..[331]: Chromosome 7, SNP identification no. = rs6951436
  misc_feature [331]..[331]: allele = a, in linkage disequilibrium with rs850470, respectively
  misc_feature [331]..[331]: n is a, t, c or g
atggtgacagagaagaatcgtgttgtatcacaattccgacatcaaacatgtctctctactacatatagttaagctttaagggagggtgctagaattaagatactgtaacacaattcagcatattggaactttggtatgaatggattccagagagaaaaaaaagagagagagagggaggcagaaagtgctatgcaaaatatgtcaaaatattttcattttaatttaggcttgcttctggatggaagtttttcttttcaaagctaaagtttgtggttttttgacatggagaattatatatttgaatcaaggtaatgcctgaactaaagtggtntgataaaaccaaagactgacattagataatataacggaaatgaaatataaatcaaaagtgttcctttcttaaataattgaattcataactcatgagtttgaatttcaaattttattcacttattttaggatggctttctaaattggcttttcccatttgatatgccaaaaacacttgatagcccaaactttcctattatagaactactttgataaactaactttgaagttgataggattattgcagacaaaaaagaatgatactgcaatgcttgaaatttaggtcaatatacatcatcttaaagattttgtaatttgatgtggacatttt

SEQ ID NO: 970 - DNA, 661 bp, Homo sapiens
  misc_feature [331]..[331]: Chromosome 7, SNP identification no. = rs11761238
  misc_feature [331]..[331]: allele = g, in linkage disequilibrium with rs850470, respectively
  misc_feature [331]..[331]: n is a, t, c or g
tatgccaaaaacacttgatagcccaaactttcctattatagaactactttgataaactaactttgaagttgataggattattgcagacaaaaaagaatgatactgcaatgcttgaaatttaggtcaatatacatcatcttaaagattttgtaatttgatgtggacattttcacattgctgtgttaagtatcacgaaggatacaaataattaaagatctagtgtctcctctttgtgtgtttgaaatctcataggataaaaaagaaatgtaatattcatttatttattcattcatcatttgtttaacaaatattgataaaacacattccatgngccagacacttcttaggtgtttgggaaacattagtttaaaaaacagacaaacattatgccttcacaacgctttaattatagcagtcagagacagacaataaacataataaaaaacaggttaaattatatgctagaatatattgtaatttataaaataagaataaaaaaggtggagtctgggttgtagaggtaagcctgatgctgttttgtatttggtcgtttctgtaggcctcatttaaaaggaaatgcttaagagattgtatgaaatgatgaggttagccatgtagatttctggaaggagagcagacagaaaaatatccagtagaaaaa

SEQ ID NO: 971 - DNA, 661 bp, Homo sapiens
  misc_feature [331]..[331]: Chromosome 7, SNP identification no. = rs10228710
  misc_feature [331]..[331]: allele = c, in linkage disequilibrium with rs850470, respectively
  misc_feature [331]..[331]: n is a, t, c or g
atgtagatttctggaaggagagcagacagaaaaatatccagtagaaaaactctatgacaaggatgtgcttggtttgttccaggaatgaatgggtgaccagtgtgactggagtagtatagacagctggagacaggttggagatgaggtaagatggctcacacaaggcaatgtaaactatcgtaaagaccgttgattttactcttagtgaggtaagacacttgggacataacatggtctgatttccacttttcaggaattattttgactgcggtgttaataatggactgaagggaaaaaggtgataaccagtgagaagcctattaaagcaacntacattggagataatcatcccttggatcaaggttgtggtagaagaagatggtgagaaatggtggtcagacgtttccttcattttgacaaccaaattttgttaagagacacccatgtttaacagagataagacttgagttaaaaagtgatgtagtttggctctggatccccacaaaaatctcatgttgaattatgatcatcagtgttgaaggagttgaatgttagagataactgaatttctcagagaaaagttgtgagttagaaagtgatatggtttggctctgtgtccccaccccaatctcatgttgaattatgatcaggtgttggagga

SEQ ID NO: 972 - DNA, 661 bp, Homo sapiens
  misc_feature [331]..[331]: Chromosome 7, SNP identification no. = rs7810370
  misc_feature [331]..[331]: allele = g, in linkage disequilibrium with rs850470, respectively
  misc_feature [331]..[331]: n is a, t, c or g
cttgagttaaaaagtgatgtagtttggctctggatccccacaaaaatctcatgttgaattatgatcatcagtgttgaaggagttgaatgttagagataactgaatttctcagagaaaagttgtgagttagaaagtgatatggtttggctctgtgtccccaccccaatctcatgttgaattatgatcaggtgttggaggagggacctggtgggagacgatcaggtcatgggggtggatttccccctgactgttcttgtgatagtgaattttcatgagatctggttgtttaaaagtgtgtagcacttccctgttcgcgctgtctctcttgtcnccatgtgaagatgtgcttgcttccccttcactttctgccgtgattgtaagtttcctgaggcttccctagccatgcctcctgtacagcctgtggaactgtgagacaattacacttcttttcttgataaatttcccattctcaggtatgtcttcacagcagtatgtgaacagactaatacagaaacaaagagccatatcaaaattttttggatttttgtgagtagttgaaggatgggattgtctttaactgacacaaggaaggctatggatagaacactttttagtggaggaagatcagcagttcaggtttgaatttgttatcttgtgattc

SEQ ID NO: 973 - DNA, 661 bp, Homo sapiens
  misc_feature [331]..[331]: Chromosome 7, SNP identification no. = rs6464691
  misc_feature [331]..[331]: allele = c, in linkage disequilibrium with rs850470, respectively
  misc_feature [331]..[331]: n is a, t, c or g
tttctgccgtgattgtaagtttcctgaggcttccctagccatgcctcctgtacagcctgtggaactgtgagacaattacacttcttttcttgataaatttcccattctcaggtatgtcttcacagcagtatgtgaacagactaatacagaaacaaagagccatatcaaaattttttggatttttgtgagtagttgaaggatgggattgtctttaactgacacaaggaaggctatggatagaacactttttagtggaggaagatcagcagttcaggtttgaatttgttatcttgtgattcccattccacatcctagtagagatattgaacanttagataaataagtgtcaaggtttcgcctagatgtataaatgtagaaatggtcaggaccaatgactgtcttggggtgttacaaaatttgaagttggtgagttagaggatattatagaagaaaaggttaaggagagactaatgagaaaataggatgtgatgttttggaaagcaagtgaggaaaatgtatcaaggaggaattatttaatccataatttgaaatgttcctgacagttcaagaaagatgaagactgaggcttgacctttgggttgagcaacatggaaagtgctggtgattttgacaaaacaatttaagtagaattgtgggagaa

SEQ ID NO: 974 - DNA, 661 bp, Homo sapiens
  misc_feature [331]..[331]: Chromosome 7, SNP identification no. = rs6962254
  misc_feature [331]..[331]: allele = a, in linkage disequilibrium with rs850470, respectively
  misc_feature [331]..[331]: n is a, t, c or g
agagccatatcaaaattttttggatttttgtgagtagttgaaggatgggattgtctttaactgacacaaggaaggctatggatagaacactttttagtggaggaagatcagcagttcaggtttgaatttgttatcttgtgattcccattccacatcctagtagagatattgaacagttagataaataagtgtcaaggtttcgcctagatgtataaatgtagaaatggtcaggaccaatgactgtcttggggtgttacaaaatttgaagttggtgagttagaggatattatagaagaaaaggttaaggagagactaatgagaaaataggatntgatgttttggaaagcaagtgaggaaaatgtatcaaggaggaattatttaatccataatttgaaatgttcctgacagttcaagaaagatgaagactgaggcttgacctttgggttgagcaacatggaaagtgctggtgattttgacaaaacaatttaagtagaattgtgggagaaaaggcctaattgttgctttctttgtaaatgtgtgtgtgtgtgtgtgtgtgtgtgtgtgtgtgtgtgcgagagagagagaaagagagagaaatacagagagagagagagagaagagagaaggatacagtgagagattaaattaatgatgtggtagg

SEQ ID NO: 975 - DNA, 661 bp, Homo sapiens
  misc_feature [331]..[331]: Chromosome 7, SNP identification no. = rs2888244
  misc_feature [331]..[331]: allele = t, in linkage disequilibrium with rs850470, respectively
  misc_feature [331]..[331]: n is a, t, c or g
caactcatgaggaactaagatctctattcaacagcccacaaggaacaatctgggaaacactacttactaccctttaaacctcgaattgattgcagcctcataagattatcagttaaacacatgtgcagttaaatttgactttcacataaacaataattttttaagtataagtatgcaatatttgtgttatacactaaaaattattcagtttgcctgaaattcatatttaattggatattgtatattttctttgcaatctggcaatcctacttgtaaagaacccagagtcagaggacccagttgagatgctctctgattccatgttcacagngacagaaataataagtgtgtttattattgtgaaatttagaggtcatttgttatgcaccaataggtaactaatataaggtaattttgatccacgccaaaggagaagagacctaagcagctttgaatgaaggccagaggagtactaagtaagaaactggaatttgtactgttttaattgcttggtaacaatgctaaaacagactagaatatacttagaagtttaggtttgtttcttttttaatatggtctagagaatatcaagatccttcaatccaccaatttccttatctacagtggatcatgataagctctctgagtatattcctaaaat

SEQ ID NO: 976 - DNA, 661 bp, Homo sapiens
  misc_feature [331]..[331]: Chromosome 7, SNP identification no. = rs4285408
  misc_feature [331]..[331]: allele = c, in linkage disequilibrium with rs850470, respectively
  misc_feature [331]..[331]: n is a, t, c or g
aaagaacccagagtcagaggacccagttgagatgctctctgattccatgttcacagcgacagaaataataagtgtgtttattattgtgaaatttagaggtcatttgttatgcaccaataggtaactaatataaggtaattttgatccacgccaaaggagaagagacctaagcagctttgaatgaaggccagaggagtactaagtaagaaactggaatttgtactgttttaattgcttggtaacaatgctaaaacagactagaatatacttagaagtttaggtttgtttcttttttaatatggtctagagaatatcaagatccttcaatccnccaatttccttatctacagtggatcatgataagctctctgagtatattcctaaaatagcttcatgatacaaactttgccaaaaattaaaaaaatagtttataatatgtccttgctgtgtctctatattttgacaatagcaaacagaagtagtgttttctggatgtcagttactgttttatatgctttacatgtattaatttatttcatctttataataactaaaataaatactggtttcatttatatagatgtggaaactgagatgtaagaaggatgaagtattttacctaggattacataatactaaaagacaaatacacactcagaag

SEQ ID NO: 977 - DNA, 661 bp, Homo sapiens
  misc_feature [331]..[331]: Chromosome 7, SNP identification no. = rs11764219
  misc_feature [331]..[331]: allele = t, in linkage disequilibrium with rs850470, respectively
  misc_feature [331]..[331]: n is a, t, c or g
aatactggtttcatttatatagatgtggaaactgagatgtaagaaggatgaagtattttacctaggattacataatactaaaagacaaatacacactcagaagacacagtgtccttgaccttaaaaaatattaactctttgttttgtgccatttcttttcccataaaatctagattagtctattactagttagactattatttttatcataacaataaatatttcatttcttagaagctttgtttttattttttcccatgaactctttcttttgtaaagccaaatcgtcacagtcagcctctatgttaaaaataaacctgcattcctttgntctgcttatatcccctctggtgggtatttagccaatctgggtttaaatcttggttctgttacgtatgaacttcaaaacctttgcaatatctttcagattcagttttctcaactgtaaaatgggaataataataaaattgttataggatatggaaaagattaaaatgatatattgtatataaagcacctgtacaacatctgatctaacaggtgcatgctaaatgctaattccattttacattcctgaatttttgttgtgtctagccttttccttcttagtcacatgaaacatggcaagagttgacatctaacacgaaaaaattttcttata

SEQ ID NO: 978 - DNA, 661 bp, Homo sapiens
  misc_feature [331]..[331]: Chromosome 7, SNP identification no. = rs6944748
  misc_feature [331]..[331]: allele = c, in linkage disequilibrium with rs850470, respectively
  misc_feature [331]..[331]: n is a, t, c or g
atgttaaaaataaacctgcattcctttgatctgcttatatcccctctggtgggtatttagccaatctgggtttaaatcttggttctgttacgtatgaacttcaaaacctttgcaatatctttcagattcagttttctcaactgtaaaatgggaataataataaaattgttataggatatggaaaagattaaaatgatatattgtatataaagcacctgtacaacatctgatctaacaggtgcatgctaaatgctaattccattttacattcctgaatttttgttgtgtctagccttttccttcttagtcacatgaaacatggcaagagttnacatctaacacgaaaaaattttcttataagaccctagtaatttatttttttcctctcaaaccacagtattctcttaatccttattctcattattgtctttatagttctggggattttattgcttctttcttttgaaaatttatcccaccctgacttctgttgcattatcttatacttatacctcgctattctgtttgacccttcctttttctgccattttagtagtactattaggatgaatgcatcattcaccaagtattattaaccatgtcctatggtggccatcagtgggctggagctctacagactatatgaatagtctggacctct

SEQ ID NO: 979 - DNA, 661 bp, Homo sapiens
  misc_feature [331]..[331]: Chromosome 7, SNP identification no. = rs6969500
  misc_feature [331]..[331]: allele = g, in linkage disequilibrium with rs850470, respectively
  misc_feature [331]..[331]: n is a, t, c or g
gatctgcttatatcccctctggtgggtatttagccaatctgggtttaaatcttggttctgttacgtatgaacttcaaaacctttgcaatatctttcagattcagttttctcaactgtaaaatgggaataataataaaattgttataggatatggaaaagattaaaatgatatattgtatataaagcacctgtacaacatctgatctaacaggtgcatgctaaatgctaattccattttacattcctgaatttttgttgtgtctagccttttccttcttagtcacatgaaacatggcaagagttgacatctaacacgaaaaaattttcttanaagaccctagtaatttatttttttcctctcaaaccacagtattctcttaatccttattctcattattgtctttatagttctggggattttattgcttctttcttttgaaaatttatcccaccctgacttctgttgcattatcttatacttatacctcgctattctgtttgacccttcctttttctgccattttagtagtactattaggatgaatgcatcattcaccaagtattattaaccatgtcctatggtggccatcagtgggctggagctctacagactatatgaatagtctggacctctacaggctatatgaatagtctggagctc

SEQ ID NO: 980 - DNA, 661 bp, Homo sapiens
  misc_feature [331]..[331]: Chromosome 7, SNP identification no. = rs10952627
  misc_feature [331]..[331]: allele = g, in linkage disequilibrium with rs850470, respectively
  misc_feature [331]..[331]: n is a, t, c or g
aggagacttccttggggtttttcaaattgaacacagcttgtataaattctttatttaaatattaattcatattttactccatcaaggatacatcatttgtgtatttgagtcctcatccacttccactctcatccttttctaaagttgtatgttttaaaaaaatgtgtcaaacaattttgccctatggtttccttctgagcagccttagcctgtcagcaaccaggtagaagcttcctgcttatctcgcattatctgctagctgtgagccagctctagcaaggtacaacccagggtaccatctttactatctcattggttttctacttgtcantcttggccccagggctgcagaacagctctgtcctggcaactcagtaaacgtctccagcatcagtgggctatcactcaccctctccaagaaggattccctctcagccttgggaagggagcctctttcccttgtttgtttcttccttgcgttctctcagccctttcataattagccattagtaggtattcctctgttcccaattaatattttttatattaaattttttcatatgtaagttactggtatggtttatgtgtcctgactggattctaactgacgcagaattatgtatgagaaagagtatgtagagtttatcacctgataaactct

SEQ ID NO: 981 - DNA, 661 bp, Homo sapiens
  misc_feature [331]..[331]: Chromosome 7, SNP identification no. = rs6966867
  misc_feature [331]..[331]: allele = a, in linkage disequilibrium with rs850470, respectively
  misc_feature [331]..[331]: n is a, t, c or g
ttctcagccagtcttccctttttcttgtttatgttaaactaaagtgtttgcattataaaaaaaataggtttctttttcttctaaggatcaagtgtaggaactaaaatgaaagatgatctattctgaattacttaagaaaagtgaaaagattttttactaatgttattgaaatctgtattttatcaataagtttttaatttataaataaaaggttattacagttcatgcaaatattttatatttgtgttaagatagttgtgacaaactcccattattaaccactttaggttttgcttcaacagttacaagctgaaatctcaatcttcttacngcactgacaaagaatgaatgaggcagaaacagttgaggttttgctttcccagggtgaattgcaggcagtgtctcaaggagaaggtggttgtaaaaaggcttggccatttccatccagtgtggggctcccttaatggctcatatttactttagagctcccctttggacaaagagactttagccggtcttcaccatggtttagtgtttctgccaaatcctgtgtctcctctgtgttactactctccgataaatattttgtactcttatcttcatttcagcatgtacttcttagagaaatcaacctgtgataaggtaatttttaaaatatata

SEQ ID NO: 982 - DNA, 661 bp, Homo sapiens
  misc_feature [331]..[331]: Chromosome 7, SNP identification no. = rs10237200
  misc_feature [331]..[331]: allele = t, in linkage disequilibrium with rs850470, respectively
  misc_feature [331]..[331]: n is a, t, c or g
caccaggtttcatctttcagactgaaggagccaagaacatttgtgtgggcttagtgaaataaagatggatataatttgtttggctgtagcaggtcttgcagaatctatttgctgagcgttaaaaatcttcagatactgttctaagtgttagtaaagagaccaggggtactaaagaatagtggtacttgtacatagtctctcaattttatatttaaatactaatgatgtgtacgtattaattacagttcacatcagtattatatttaattcattgatttgtatttttgtgtagtagtttatacagataaacatgtaacttaaaaaattattnacacttaactttaattatgtgtggatttgtttacatattaaacaaatattattgagtccctactacctgccaagcactgttccaaacttttggaatacagtggaaaataaaagagagggaataaaactctctgtcttcagagactttgattgttgagttcttgaaaatctaatgttacagacactagcatatagtattaatagtttttattaatatataagtaagtaaaattgacctgtataagcaatcttgttgccatactactcaaacagtgctaaatgtgaattgttttaatcatcacatagacatggcatttaaaatccacctggt

SEQ ID NO: 983 - DNA, 661 bp, Homo sapiens
  misc_feature [331]..[331]: Chromosome 7, SNP identification no. = rs10266218
  misc_feature [331]..[331]: allele = c, in linkage disequilibrium with rs850470, respectively
  misc_feature [331]..[331]: n is a, t, c or g
actgttccaaacttttggaatacagtggaaaataaaagagagggaataaaactctctgtcttcagagactttgattgttgagttcttgaaaatctaatgttacagacactagcatatagtattaatagtttttattaatatataagtaagtaaaattgacctgtataagcaatcttgttgccatactactcaaacagtgctaaatgtgaattgttttaatcatcacatagacatggcatttaaaatccacctggtaatagttgatgttttttcttcatgcctactatttgtgggtaacaggtgagtagtatgtaaaaacaccgtagcatancacgggcatccataccacataaaaagtacaagatttccaaaagagatgatggatggatggatagatagatagatagatagatagatagatagatagatagatagattccacaatcacagaaacataaatatttatatacttatataatcaactgtgtgtgaatgtgtatctttgtgtcccacaggctgattgtataggagcacaaattagaaactaggtgaccatctctcttgggagacaccccactgatcaccacacaagtatgctggcctaaggcataacattttaagagagctgtgattgcataccttcaggcaaataggtgacaga

SEQ ID NO: 984 - DNA, 661 bp, Homo sapiens
  misc_feature [331]..[331]: Chromosome 7, SNP identification no. = rs850571
  misc_feature [331]..[331]: allele = t, in linkage disequilibrium with rs850470, respectively
  misc_feature [331]..[331]: n is a, t, c or g
tccttatttgaactggttcctacacgttttgacaatgtgacttttaacgttttgttgaaacttttcttaattactaggtttattcacctttccgttgtatataaatactcaatcttctaaataataattctaccgttacgatgaatttcaccggatgtcccaatgactttaaggttagttttagagttattcaaaaaagagaaacgtctttactttctcagttaggagtctaagtgtactttaacgttcttctgggtttatcgatttctttatgacttgttcttcttgtttcgatctcctgtataagaaagattatagttgtaaaaataangtttcgatgtctttaagtttgtcgcaccgtgaacttgttcctacctacatgacatatctagttaccttatcttaattttcaagtctttatatgggtatgtatttaccggttatctaagatcgtttatacggtactcttaagttaccccttttctatcaaagaagttttttaccactaccctgtttgttgatctattggtatatattttttatatctatacacgggtgtgtgttatatgttttaattgagttttatctgaccattgaattatatcttagtttaatattttgtaaattttcttttgtatgttcatttgaaaatactggaaac

SEQ ID NO: 985 - DNA, 661 bp, Homo sapiens
  misc_feature [331]..[331]: Chromosome 7, SNP identification no. = rs850570
  misc_feature [331]..[331]: allele = c, in linkage disequilibrium with rs850470, respectively
  misc_feature [331]..[331]: n is a, t, c or g
ttctaggtctattaccaaaaccgagttcgaaacgtccgtctttacaatttgggtaaaatatttattcgtatataaaaattatttggacacttggatagtcctatgttctataggttatattgttcgaacgatggtttatctgacaaccagaaaatcattctcgatttataatctcccagtcaaaattagagacgatgacaatctaatctttaggtcttaatcttcgaaaatacagtttgaaccatttactctcagacacaaaaactcgggtagacttcggaggtgtatcggttacactggtcgagacgatgtgactctcaactcttccatnagttatcttgtactgtaatgatccgttttatctacctgtcgattattctcacgactacctttcttccatttctccatttgttcttagtctttctaaagatttagggtctggaaccaatcaaaccttagaataatggataagtttcttctccaccggttctggagttctccttcttaagttaataaagggtttttctgagtttcagtaaaaagtctagcgacatgagaattgtaaaactcctactaatccacgtcctaaccttaacctctatgtctgcactatacaggacaatttcaccctcggtcttcagattttagtcaaactgactct

SEQ ID NO: 986 - DNA, 661 bp, Homo sapiens
  misc_feature [331]..[331]: Chromosome 7, SNP identification no. = rs4015699
  misc_feature [331]..[331]: allele = a, in linkage disequilibrium with rs3864498, respectively
  misc_feature [331]..[331]: n is a, t, c or g
ccctcccaatggacttccattccctcagctataaattcaaaggattggaacaactgaacatttgagcttctttcatcttctaagtcaagattcatactagcagtagtatctttcttgctatgaaggatttgaccaggtatacctctatctttaggtgaaaaattaggttgtactatttcctagaaggaacaaattcagcttgacaacagttgtgtagaaaaatatgtgttatttagttggccctacacttaataagccataaactgatacagctgtgaacactattactagaatagtggcattcacatcgttcacagtaaaatcatctcantgagccttccaccaatgtcaccagggcagagatattctgttaatctctataaacacgcgctgtgtgatgcctatcaatgaactgtagtttagttccactcaaattgcaaagaagtctagaaaccatgtgatactagaatgaactgaaaagtggttatttgtaagaaaaaacacttgttcttgtgtgcagaggagtgggcaccaagtaagaagaggcatttggtatcagcactttgaatacatgttaaggtcctgttgggtttccaaataagaactgtgattgtgaagggtcctcttcttttctagaaaactaatcaaccatggaatgtgg

SEQ ID NO: 987 - DNA, 661 bp, Homo sapiens
  misc_feature [331]..[331]: Chromosome 7, SNP identification no. = rs4725865
  misc_feature [331]..[331]: allele = t, in linkage disequilibrium with rs3864498, respectively
  misc_feature [331]..[331]: n is a, t, c or g
cagcatgcagatctcacactcatggggagacgagcccctctgctcggactccatttatgacagtacagttacttagcaaagagtcacacaataaaccctaaacaagaattacattatgcaatcataacatatgcacgttaaagggattttacagattgtctcaatcagggagtgccatgaaaggaatccacacatggacatctgacttccaattcaacgtgctccctgataccacaccacctttcaaaggcatcccttgaaacctctgcttgtttttctagatctagttagcttggttttcctacatttgaaaagaagtgttccaatgagnattgacataacaggaaaaaaaaaaactgatcatctaataaatctgttgtgtctccaacaagcctagtctttaaatacacacagcaatttattcaattactatcaatctttgcaacatgatttgtgggtgacaagaaaaataatacacataaaagtggctttgatgcttatgatgctcacatataaatatatctactgatcagattatctgaatcaggctgctaatttgtggattgatactatttgtggattgatagctgaactatttgccagctttagtcgtttaattcaagtgataaatactgtatttgctcccataattccttctcgc

SEQ ID NO: 988 - DNA, 661 bp, Homo sapiens
  misc_feature [331]..[331]: Chromosome 7, SNP identification no. = rs13227764
  misc_feature [331]..[331]: allele = g, in linkage disequilibrium with rs3864498, respectively
  misc_feature [331]..[331]: n is a, t, c or g
cccagatagctggtaggacattatttctggattgtgtccatgagggtgtttctagaaaagatgagcatttgaattggtagatgaagaagatccattctcaccaacataggtgggtgtcatccaatctgtttgataaatcaaacagggaggcttagagtccaggagctgggacagcagaggagactgaggctgaatgcacacagcacttcacatatccacgtgccaagctcacttgtctctactgaaggatgagtgagctgatggaactggaacacccagatgtcttcttaatacactggaaggagggaaatggtggtcctttactgcatcntgagccttcatccccacatacacaggggataactggccctggtttgggatatatggtttcctctgcctccatttttcccatttttatgtgaaaatgattgtaggctggaaaggattctgggagtgccaggtcacttacgtgacttctggaggtgctgctgtaaaaagcatggcacaaaggcctcttctcctgggctacagcactctgggaggagcagacattgaagtagcacagcacccccgagtaccggcatcagggaaacttacatatggctgcaggacttggcaaactctaagatcttaggcccattttatgacttcctgtcctcgt

SEQ ID NO: 989 - DNA, 661 bp, Homo sapiens
  misc_feature [331]..[331]: Chromosome 7, SNP identification no. = rs4367449
  misc_feature [331]..[331]: allele = t, in linkage disequilibrium with rs3864498, respectively
  misc_feature [331]..[331]: n is a, t, c or g
atgtgttacgtagcaggtctctgatctgttttggggctggaggtcatctccacagtgagaatttgagctcactgaggtcagaggctatttaaactcacttgcaattttcagagcttgaacatcatgctagagacaagtcagcacggcaagaatgcttgctgaactgcttaaaacatgacatgaatggcataggaatgacagctaagtaggagaaaaagctctggatcagaaccagaagacctggtcccaactctgactcttgaactacctgagactctaggctaatcttttaatgttctctaacacttcctgcacaacaagaggtttgganccgctgatctacaaaagctcaaagtcatcaggcagcttctccaaccgtttattcttccccttctttctacttccctctccctgagctttctccttccttctctcatctgcatcttcaccctgcaccacatcccacagtgggacttcttcacagcaattccccacagagatgctctatcacgcttttatctagaggaaaatttaaaacacatggacacagaattcagaatgtaaacaaataaaacccaaaactacatcttgacatcttagacagcaaagctgctgtatgagtgtttgtgtgtgtatgtgtgtgtgtgtgtgtgtgtgtgtg

SEQ ID NO: 990 - DNA, 661 bp, Homo sapiens
  misc_feature [331]..[331]: Chromosome 7, SNP identification no. = rs6947979
  misc_feature [331]..[331]: allele = c, in linkage disequilibrium with rs3864498, respectively
  misc_feature [331]..[331]: n is a, t, c or g
gcacaccattggaggtcagtaaggagctttggtctcagatgtgcaaaggaggccaggtactccagggggtgatggatctgacttatgttttaacaggatccctgcggctgtcttagggagaatgggtgtgggagggggagtggaagcagggacctcttgggagtgacttcagagattccagtgagagacaacagtggctggggctggattggtgcagccccagtggggaggtgggtgtactgcatggattaggggtatattttggagatgggatcgatgaggcttgctgaatggttaaatgaggtgaaagggaaagtgaacgaatgacaancccagggcttgtggcttgaccacctgggttggtggtggtgccatttactgagatggaacactggtggaggagcaatggccgtggggatgaggagctctcttctggccacatgttagcgaggacatgttagacatcagagtggagtggtcagatgggcactttgaaaactgagtttgcagttcacttacgaagataaggcttgacatgtaaaaccaggaatcctcatcatatggccagtatatgagactagggcattgagaagctcatccaggaatacaatgcatccagaagagggcaggcagataagacttcaatgctgagaggtcacgc

SEQ ID NO: 991 - DNA, 661 bp, Homo sapiens
  misc_feature [331]..[331]: Chromosome 7, SNP identification no. = rs3864498
  misc_feature [331]..[331]: allele = a, g
  misc_feature [331]..[331]: n is a, t, c or g
tagaggaatgaaatgaataagatcattgaggtgatataactctggaaccagaactcacacccattatgatttctagccttggttgacctgttatctacacatgcatgaggatgaagcaggttgtatggggtggggtggggacaaatgcacacacactctttgagtttacaaccttgggttcaaacagtaaccagctgtggtttgttgtcatttgctgccgaggttgatacatcacgaagaatacaaatttcatcaagaatataatttaaagtatctttgaggcagagctttttaaggagagctgggctctcagcagatcattctcacactntatttttttattcaggtgaaataaaatttaaatgaatatcagtgtcaactttgaagaagacacagggggacagcctaaagatgtgtttgtaagaagatgggatcaatcttggtgctagatctattgcttcacaagagttcattcatctgttcattgcatcagcactcttgaaacccctgctaggttacaggccctgaaatagacactgattcagatacaaccttgacaaaaacaaagcttacattttagtgaagtctaaactctgtggttatgtagaagactgctgccgtgaagcaggagtgtggcttctacttatgatatttcatattt

SEQ ID NO: 992 - DNA, 661 bp, Homo sapiens
  misc_feature [331]..[331]: Chromosome 7, SNP identification no. = rs4406321
  misc_feature [331]..[331]: allele = a, in linkage disequilibrium with rs3864498, respectively
  misc_feature [331]..[331]: n is a, t, c or g
tctacttatgatatttcatatttagtagaaggataagaaaaatgtttggatgcatgtgtgtgaataatgtgaatatagaattaccaagtataccggggaaggaggaggtagggggagagagctatgacttcaagttaagaaaattggaaaatcttgtgaaaaagaaggtatgggacctgtattttaaataatggacagtatttcaagagataaatatgagggatgagaatttcagggacagaatgggccccttatagggtgaggaactgccttacagaagcaaggagacaaaaacgtttagagcttttttggaggaagagcaagtaccccntttggtcgtagtgtcaattgtatgtaggagaagagggtgaggatgatggaataattagagcataaaggacttcagccaattctgtgattaaactgacaatgaacatctgatagcctggaattgacatgattaggcctgggctctccatagtgatctgatagcagtgggtaggacggattagatgctggagaggagaacagcaggtgtggggcacaccaggggactgttccaatcatggaggatgcaagtgatggctataggaagaaaagggcattagttataggacaccacacttacactggagaaagaattgtcaaaatgtggtcactt

SEQ ID NO: 993 - DNA, 661 bp, Homo sapiens
  misc_feature [331]..[331]: Chromosome 7, SNP identification no. = rs17173853
  misc_feature [331]..[331]: allele = c, in linkage disequilibrium with rs3864498, respectively
  misc_feature [331]..[331]: n is a, t, c or g
ggttcgttctcttccaccttctgccatggaggacacagcaagatggcccttgccagatgccagcacttcgacctcagactttccagaccccaggactgagagaaaacaaatttctgtgctttataaattatccagactcaggtattttattatagcaacacaaagggactaagacagggagtgtaataagttaaagatggagagtagttgtggggaaggactgagagtaaggtgctggagaggcagctgcaaggtggggaagttgcaagaacctcctggaacatcagtgtgtggactcagcacatcccccacagaccgctgtctaatgganggtgaattactcaggatggctgcgtgctccaaactggtcccttaggccctaaattaacacctgcaggattggacaaagtcatgatgcaaagtcgggtgcgaccagaggccactggatttaagcaaatgcacatgagtgtaaccaggggaaagaagactctaaatatccctgctgtagaaaatcaatgctccgtttttaaaacatgcttaacacttcattttttagctacaaatacatttctgttagaatagttactaaaaacctacaaaggaatttgtatagctttgcatgaatatttattttcttctatggatgtaaactaattcagga

SEQ ID NO: 994 - DNA, 661 bp, Homo sapiens
  CSMD1
  misc_feature [331]..[331]: Chromosome 8, SNP identification no. = rs10089026
  misc_feature [331]..[331]: allele = a, in linkage disequilibrium with rs10503262, respectively
  misc_feature [331]..[331]: n is a, t, c or g
tgctaatttcatatagtaatgtataaatgaaatgatacctcacttaaatttctaggaatttcagtgttaaatatattggaattcattgtaaatacaagttaattagtgcctttgtctttgtgaacttcatacaaatttaaatttgttatcacgatattcataaatagctgtagtttttccatgattcatgcatgtaagcattcctttaaaaacagtcaagtaaatacagaaattttgatacacatgtcagtattgtggcatatgagaaggttttgaacaagtgtgaaagtcttaaaaaatgaaaaatcagatgtggaatgttgaaagctcntatttatgagttaagatggataacacatccaaagctgaaacgtgttcagcatcttattcctgcacaaaatctcccatttgttatcctcctacacccggcaaaaatcacaggagaaaactgcaagtccccacacaccagctgtccacttactcaccctcctcccctccccaaatgtagctttccattccattattctaatatttaaaagcatgcttcacaaaaagtttatgcctgaatggaaaaacaaaatggaaacttcgagtacacatgtgatttaaatgactaccaaagcttagtcagatgtatacaaatcagtgttgcaagttgaca

SEQ ID NO: 995 - DNA, 661 bp, Homo sapiens
  CSMD1
  misc_feature [331]..[331]: Chromosome 8, SNP identification no. = rs10092807
  misc_feature [331]..[331]: allele = g, in linkage disequilibrium with rs10503262, respectively
  misc_feature [331]..[331]: n is a, t, c or g
aattatttttaatagtactagaacttacgatttttgatgaaaagtacacagcaacatagctaagggtgtgtgtgtgtgtgtgtgtgtgtgtgtagccagggcaaatgattagctaaatatctcaatgtgcctctgatatagttcagatatttctcaacgtgcaagagtgcgtgcgtgtgtgtgcatgtgtgtttagccagggcaaatgattagctaaatatctcaatgtgcctctgatatagttcggatatctgtcaacgtgcaaacctcatgttaaattgtaacccccagtattggaggtagggcctggtaggaggtgactagatcatgntggggcagatttctcatgaatagtttaccaccatcctctcggttgctctcctggacacagcgcaaaagattcaccaaaattgaactgaaaagtgtgtggcacctctcactcctccccttgcttccgcatttgccatgtgttgcgctggctcctcctttgccttctaccatgattggaagcttcccgaggcctcaacagaagccgggcagatgccagtaccacggttcctgtccagcctgcagaactgtgaaccaattacacctattttatcggaaaattacccagtctccggtatttctttatactaatacaagaatggactaatacagc

SEQ ID NO: 996 - DNA, 661 bp, Homo sapiens
  CSMD1
  misc_feature [331]..[331]: Chromosome 8, SNP identification no. = rs10503262
  misc_feature [331]..[331]: allele = a, c
  misc_feature [331]..[331]: n is a, t, c or g
gaaccaattacacctattttatcggaaaattacccagtctccggtatttctttatactaatacaagaatggactaatacagcctcacaagtggaatttctcttaatgaagttgcaatggtctattccaacggaatcagaaactagattttctgatgctaagattttcagggttaaatgtatattaagttcacgtaaccaacatataaagacatagtgaaaagttaataaattacagcttataggaattagactacttacattgatacctatactgatatgacagttttattatttttatttaactcactctaggcctgtatgtgaaaccanattgtaatggaagaatgcctgctcaaacaaggaattcagaacaagaaaaagaaagacataagataactgacaacaatcagataaaagaaaagttgacgcctcaggttaacagaacttgtatcatcaatggacagaagccatctttatcttttcagtagttatgagatttttgacaacttgaagtctatacaatgttctttccagaaaaatagacttacaaaattacgcatataatttcacagcttcatggaaagagatatttcatggccctcaaattaagaaagatggatatatagaatatggacagtctcacagtggaccagaataatc

SEQ ID NO: 997 - DNA, 661 bp, Homo sapiens
  misc_feature [331]..[331]: Chromosome 8, SNP identification no. = rs17150201
  misc_feature [331]..[331]: allele = a, in linkage disequilibrium with rs6601328, respectively
  misc_feature [331]..[331]: n is a, t, c or g
tcaattaatttcaagggacttttcagcagattttcacaaaaacgaacttaattttgtatgtccagcaagaacttttgtaaaccttttaaatataccctagaatatttttagtgataaagataagtgcagagatccattaactgaagggaaaaatgtttgggaactattgaataaaatttcaagcctaataggttttgaaatcagtattacaattataaggaaatatttcgtatataatgctctctgggttttgtttaatagtcataccaattaacttctcaatttcaatagaaatgtaggaaattcacctctgttcagtacttgacaaatnaatcatggtaattacatattcacatggcctataataactcttctaactcagcctagtaagcaagtgtcttttttttttttttttttttttggagatagagtctcactctgttggccaggctggggtgcaatggcacgatcttggctcgctgcaacctccacctcccaggttgaagtgattctcctgcctcagcctcctgagtagctgggattacaggcacgtgccaccacacccagctaatttttgtatttttagtagagacggggtttcaccatattggtcaggctggtcttaaattcctgacctcgtgatccacccacctcggcgctc

SEQ ID NO: 998 - DNA, 661 bp, Homo sapiens
  misc_feature [331]..[331]: Chromosome 8, SNP identification no. = rs1471203
  misc_feature [331]..[331]: allele = t, in linkage disequilibrium with rs6601328, respectively
  misc_feature [331]..[331]: n is a, t, c or g
gttgactaacgtactacggacggacgtgaccactcccactagaaatgactcaggtacctaaatttacgattagagaagacgtttttgagagtgtctgtgtaggtctttattagaacatagtcgatagaccccgagggaatcaggtcagttcgactgtatattttaattaggagtgtgagtggtccgatccactccttctcctccttaagtcccgtccttaattactggtacacaaggaagaagatgatggtcaaagatttcgtccgagttcgaccactcccccgtcaaaattgaaaggttgttcaaggtaaagagatgctaaaataatagnacaagtacatatgatattttgttctgataagaattttttaacatgaggttttatattgtaacaaataaaataaaaaatctctgtaccatagtggtacctctcgtcaccgtattagtaacgagtgacacgtcggaacttgagaatccgagttcactaggaggacggagtcagagggttcagcgagtccacgtgcggtggtaaaaaaaaagaaaaagaaaaaaagaaaagaaagaaagaaaagaaaagaaaagaaaaaaaaaaaaaaaaaacttctatattcccgaatgacataaagttccgaccagagtttgaggactggagttcactagg

SEQ ID NO: 999 - DNA, 661 bp, Homo sapiens
  misc_feature [331]..[331]: Chromosome 8, SNP identification no. = rs7009486
  misc_feature [331]..[331]: allele = g, in linkage disequilibrium with rs6601328, respectively
  misc_feature [331]..[331]: n is a, t, c or g
cgttagggacatcattttctcttgcactattctcatctctataaataacgtaaatgtgactggaaatcccgtgtcaatttacccttagcacatggattggtctgcttgagctgccatcacaaaatgccagactgggaggcttaaacaacaaatttattttttcacaattctgaagactcggagtctaaggatgccagtatggctaggttctgatgaggggatcttcctggcttccaaaaggatgcctttctgctgggtgctcacatggcaaagacagaggaaaactctctggtgtctcatcctataagggcactgctatagtgtagatatntgtctcctcctaacctcatgttaaaatttgagactcagtattggaggtggggcccaataggaggggtgtgcatcatgggggcagatttctcgtgaatggttttgtgctgtcctagtggtaatgagtgagttctcactcttttagtccccccgcaaaaactgggtttttgtttttgttttaagaatgagtttcgctgttgttacccaggctggagtgcagtggcatgatctcagctcactgcaacctccgcctccctggtgcaagcgattctcctgcctcagcctcccaagtagctgggattacaggcgcttgccaccatgaccagctaat

SEQ ID NO: 1000 - DNA, 661 bp, Homo sapiens
  misc_feature [331]..[331]: Chromosome 8, SNP identification no. = rs13261395
  misc_feature [331]..[331]: allele = g, in linkage disequilibrium with rs6601328, respectively
  misc_feature [331]..[331]: n is a, t, c or g
ataacgtaaatgtgactggaaatcccgtgtcaatttacccttagcacatggattggtctgcttgagctgccatcacaaaatgccagactgggaggcttaaacaacaaatttattttttcacaattctgaagactcggagtctaaggatgccagtatggctaggttctgatgaggggatcttcctggcttccaaaaggatgcctttctgctgggtgctcacatggcaaagacagaggaaaactctctggtgtctcatcctataagggcactgctatagtgtagatatttgtctcctcctaacctcatgttaaaatttgagactcagtattgnaggtggggcccaataggaggggtgtgcatcatgggggcagatttctcgtgaatggttttgtgctgtcctagtggtaatgagtgagttctcactcttttagtccccccgcaaaaactgggtttttgtttttgttttaagaatgagtttcgctgttgttacccaggctggagtgcagtggcatgatctcagctcactgcaacctccgcctccctggtgcaagcgattctcctgcctcagcctcccaagtagctgggattacaggcgcttgccaccatgaccagctaatttctgtatttttagtagagacggggtttcaacatgttggccaga

SEQ ID NO: 1001 - DNA, 661 bp, Homo sapiens
  misc_feature [331]..[331]: Chromosome 8, SNP identification no. = rs4841169
  misc_feature [331]..[331]: allele = t, in linkage disequilibrium with rs6601328, respectively
  misc_feature [331]..[331]: n is a, t, c or g
gtgatccgcccgccttggcctcccaaaatgctaggattacaggagtgagccaccacgcccagcctaaaagctggttgttaaaaaaacccagcaccttctccctctctcttgcttccagtctggccacatcgtctctgacatgcgagctccccttcaccttccaccataaatggaagcagcctgaagccctgaccagaaacaaatgctggtgccatggttcttgtacagcctgcagaatcatgagccaaataaacctcttttcttcataaataccccagctccaggtattcctttatagcaatgcaaatggactaagacaggccctaatccngtaatgaaggccccacctttgtgacctgatctatacctaattaccttccaaaggccccatctccaaataccatcacattgaggggtagggcttcaacacaggaattttaggagacacaatccagtctatagcagcacagttcattgtctcttctgctatatcagttctccctattaggttttattgaggtttgggcctttagatttaatatggtttttctgcatggctgaatttcctttttacaatcgttgtttcttcctttttttctttttaagaccaagggcatgaatacaggggatcactacacaggcagtcaactacaatcttcta

SEQ ID NO: 1002 - DNA, 661 bp, Homo sapiens
  misc_feature [331]..[331]: Chromosome 8, SNP identification no. = rs4840423
  misc_feature [331]..[331]: allele = c, in linkage disequilibrium with rs6601328, respectively
  misc_feature [331]..[331]: n is a, t, c or g
gccaaataaacctcttttcttcataaataccccagctccaggtattcctttatagcaatgcaaatggactaagacaggccctaatcccgtaatgaaggccccacctttgtgacctgatctatacctaattaccttccaaaggccccatctccaaataccatcacattgaggggtagggcttcaacacaggaattttaggagacacaatccagtctatagcagcacagttcattgtctcttctgctatatcagttctccctattaggttttattgaggtttgggcctttagatttaatatggtttttctgcatggctgaatttcctttttanaatcgttgtttcttcctttttttctttttaagaccaagggcatgaatacaggggatcactacacaggcagtcaactacaatcttctagatagttgtactaacagtatagttgtcattttgtaatgtgtaatttttttctttttttgtgagacagagtctcactctgttgcccaggctggagtgcagtggcgcaatctcggctcactgcaagctccgcctctcaagtgcacgccattctcctgcctcagcctcccgagtagctgggactacaggcgcccgcccccatgcctggctaattttttgtatttttagtagagaggggttttacca

SEQ ID NO: 1003 - DNA, 661 bp, Homo sapiens
  misc_feature [331]..[331]: Chromosome 8, SNP identification no. = rs4841171
  misc_feature [331]..[331]: allele = a, in linkage disequilibrium with rs6601328, respectively
  misc_feature [331]..[331]: n is a, t, c or g
aagacaggccctaatcccgtaatgaaggccccacctttgtgacctgatctatacctaattaccttccaaaggccccatctccaaataccatcacattgaggggtagggcttcaacacaggaattttaggagacacaatccagtctatagcagcacagttcattgtctcttctgctatatcagttctccctattaggttttattgaggtttgggcctttagatttaatatggtttttctgcatggctgaatttcctttttacaatcgttgtttcttcctttttttctttttaagaccaagggcatgaatacaggggatcactacacaggcantcaactacaatcttctagatagttgtactaacagtatagttgtcattttgtaatgtgtaatttttttctttttttgtgagacagagtctcactctgttgcccaggctggagtgcagtggcgcaatctcggctcactgcaagctccgcctctcaagtgcacgccattctcctgcctcagcctcccgagtagctgggactacaggcgcccgcccccatgcctggctaattttttgtatttttagtagagaggggttttaccatattagcctggatggtctcgatctcctgacctcatgatctgcccccctcggcctcccaaagtgctgggat

SEQ ID NO: 1004 - DNA, 661 bp, Homo sapiens
  misc_feature [331]..[331]: Chromosome 8, SNP identification no. = rs11785485
  misc_feature [331]..[331]: allele = a, in linkage disequilibrium with rs6601328, respectively
  misc_feature [331]..[331]: n is a, t, c or g
ccttttctgcagaagagaatgcaacatccctggatcactcagttcattcttctccttgacatcctgcaacttaaatactatgacataaggttcattattatgaatacatcttatgttagctgataaggtgataagagaaggaagaaagcaaagaagtatatacatatattacaacaaagtaggaagaagtactcataacatttacagtcctaatttctgcgactggtcaagagttggagctggtatttacaactacttcttttcattccccattccctatttcctttggccacagcagacacctcagctgatcatagttctttgcttggtntggtgaccagattttcacttctgaaagacctgaattgggctgttgtagttttattttatttttttcattgactttaatcaaagggcagaataacactaaaagaatcacctaagggatctacaggggtctcctgtattccagattttctcttccttacctccattttgtagtagtagcccaaattctccttggtaattaggagcaatgatcccggaaagtatactaactcccttctttacctgttaattcagatgcatgaggagctcaaagtggctgggtggcagtcttaactcccagctcagtggaataattaatgtgtctcctggtgga

SEQ ID NO: 1005 - DNA, 661 bp, Homo sapiens
  misc_feature [331]..[331]: Chromosome 8, SNP identification no. = rs7388554
  misc_feature [331]..[331]: allele = g, in linkage disequilibrium with rs6601328, respectively
  misc_feature [331]..[331]: n is a, t, c or g
tggagctggtatttacaactacttcttttcattccccattccctatttcctttggccacagcagacacctcagctgatcatagttctttgcttggtatggtgaccagattttcacttctgaaagacctgaattgggctgttgtagttttattttatttttttcattgactttaatcaaagggcagaataacactaaaagaatcacctaagggatctacaggggtctcctgtattccagattttctcttccttacctccattttgtagtagtagcccaaattctccttggtaattaggagcaatgatcccggaaagtatactaactcccttntttacctgttaattcagatgcatgaggagctcaaagtggctgggtggcagtcttaactcccagctcagtggaataattaatgtgtctcctggtggaagcattccttactttggaactacaacttcttaaaccagcagaatctaagatcacagggacaggaggcaaaaattttgttagtgaatcagtagggttaatagtgagtggtgccactcccacttccaccctttgattcctgaacctgtgaatcctggctatgggagaaaaaacaccatatgctaaatgctgaattagagcatatacatcctcttggagaatcttgcctctgctctg

SEQ ID NO: 1006 - DNA, 661 bp, Homo sapiens
  misc_feature [331]..[331]: Chromosome 8, SNP identification no. = rs6601328
  misc_feature [331]..[331]: allele = a, g
  misc_feature [331]..[331]: n is a, t, c or g
tcccacttccaccctttgattcctgaacctgtgaatcctggctatgggagaaaaaacaccatatgctaaatgctgaattagagcatatacatcctcttggagaatcttgcctctgctctgcaaagtgttaccactgactcagttagagactcagtgatctgaatctcttcaaaaagccattccacggttctatcaagacacctgtttcaggataatggggacatggtaagatcagtgaattccatggcaattggcccatttccatacttaatttgctgtgaaaatgagttacttaatcagaagcaagacttcttacaatgcttgtaccatnacagtagctaaggcagtctataagtctacagatggcagttttggcagaagcactgtatacagaaaaggcaaacacatatctagaataagtgtctagtgcaataagaataaaacaccatctattacaggatgcaaatggttcagtataatcagcctgcttccaggtaactggctgatcaccccagaaagtggtgccatactggggacttagttttgatgtctgatgctagcagattgggcactcagcagtgattatagccaagtcggtttggtgagtggaagtccatacataaccttcgtccttgccactatggccattttgtgcatgagt

SEQ ID NO: 1007 - DNA, 661 bp, Homo sapiens
  misc_feature [331]..[331]: Chromosome 8, SNP identification no. = rs11781665
  misc_feature [331]..[331]: allele = c, in linkage disequilibrium with rs6601328, respectively
  misc_feature [331]..[331]: n is a, t, c or g
atgattacattaggcccactcacataatccaggaaagtctccctgttctaaagtctgttgattagcaagcttaaattccatcttcgatgttcattccactttgccacataaagtaacatatctgcagcttccagagatttggacttgagtatctttgaggtgccattattctgcccaccttaaatgtggatataaaaatacattgtagattgctgtattatctgtagtctttgatttttttaggttttctgttttttctctcatgttgttggccctctctcatgtgtggtgattcaaggttgtaaattcatcttctgtgggatgttccttntgcaaacatcctggaccacactgacttcaggaattatggctgtgttggtttctcttgaggtggtcttggcagctgtggtggttttccacacaacagagatggtttctcagcactgcagggaggaatatgtttgagagaaacctgcctacctcaggctgaggtgccttcctttgtagagtttctatctctcctaaatcctgaccacagccagaagggactatttgcatttcccttaatataagagtcccttttcatttccaagcttattagaccttcctttaagacactgtaaagcaaaagcagcagcatgcatgggaagccaaataacaa

SEQ ID NO: 1008 - DNA, 661 bp, Homo sapiens
  TNKS
  misc_feature [331]..[331]: Chromosome 8, SNP identification no. = rs7013834
  misc_feature [331]..[331]: allele = g, in linkage disequilibrium with rs6601328, respectively
  misc_feature [331]..[331]: n is a, t, c or g
aagtgaatccaaggaattcttcagtggttgcacagtactcattacaaaactcactgtagttggtagtctctgcatatggatatatttacactttagtttttggtgtgcaggaatacagttagatttggacagctttagagtagttttgtcgtttgtgtgctagtttattttgtttttacaagggtatgtcctttgaggacagtccagaccaaaagaggtttaatacaacccaacacatgtttgaggatctattgtagccttaataacccaatgaaagacataaatgaagtgtttgaaagtttcccttcttctaaagaagtttgcagtctanacggggagaccaaaatatgccaatgtgaaacaactggagaagaatatttggatgcattatatgatgatggaagaaatataggctttgatgttgtggccactattatttgttgtctagcagaccatttacctcgtgtcagttgcctcagttttctcatgggcaaaaatcataaaatgatgttgtgcgagcatttggtgagaagtatctggcacaaagttctccctcaaaaagtgtgaatttcttaagctctggaccccacacttgtctttttttttttttttgcaagtagttgatgattttctctcaaagacacctaataatatgtttata

SEQ ID NO: 1009 - DNA, 661 bp, Homo sapiens
  TNKS
  misc_feature [331]..[331]: Chromosome 8, SNP identification no. = rs13274310
  misc_feature [331]..[331]: allele = a, in linkage disequilibrium with rs6601328, respectively
  misc_feature [331]..[331]: n is a, t, c or g
tttgcttttatactgtgaaagtttccatagactatatgtaaatgaatgagtgtgattgtgttccagtaaaattttatttatgagaataggtgatgggccagatttggtgtatgggttgtagtttgctgacctctgttataaggcattatatgtggcattttttccattttgtgttctttcttttgtagtcctttcttgaaattattttttcttttattttgaattattttctgaactctctccttttatttctaactcaggcacatgctatacgttcatatcttgtatcattctcgtattctcttttagctagtgttaaaataattgattntaattttgtctgctttgtgggcatttttttctgttaggtattaattgtctgcggggatgttattctccaaattcttcttgtaagaattttgtatgtatttgacctcagttactttcgttgctcatttttacagaaattaattactaaataatttcaaggataaaaataaaggtctgagatagttaaggtaatcccccctgtccctttttgttgtgctacacctgcagctctggcctagaatagatcaagtctctcagtaaggtctgcaggatcatcttttacagtagtagcatttaaattatgaaacatcatcattttatacctctgttt

SEQ ID NO: 1010 - DNA, 661 bp, Homo sapiens
  TNKS
  misc_feature [331]..[331]: Chromosome 8, SNP identification no. = rs13265363
  misc_feature [331]..[331]: allele = t, in linkage disequilibrium with rs6601328, respectively
  misc_feature [331]..[331]: n is a, t, c or g
ttcttttaaggcttcatcagatgtctaagtttgctttcaccagagcgagttactgagttctcttctcgaatcttgttttgccagtttgttcaggtatctgtttatagaattaaagcagcgtgagggtaaacttttttttaagctgttttttggagtgtgtcagctccccattcaatttagacaagttatttatttatttatttattttggttttggaagagggaaaataacgtgatgtaaaattttttctctatcccttttgccttttcagtagaacaaactaaactgctggtaggtggcagatgtttggacttgtttattttttcttctntggtatattttcttttaaagtgaggaagcatttggtagttagcagatgatttccatgaactacaagtccaaactgaacaaaatttgttttaaatttactgattgactcaaaaaaccttaaagctatagtctctgtgtcattagttcaaaaataaactaaaccagccaggcgtggtggctcacgcctgtaatcccagcactttgggagggcggatcacaaggtcaggagatggaggccatcctggctagcacagtgaaaccccgtctctactaaaaatacacacacacaaaattagcctggcgtggtggcgggcgcctgttgtcccagcta

SEQ ID NO: 1011 - DNA, 661 bp, Homo sapiens
  TNKS
  misc_feature [331]..[331]: Chromosome 8, SNP identification no. = rs11784858
  misc_feature [331]..[331]: allele = c, in linkage disequilibrium with rs6601328, respectively
  misc_feature [331]..[331]: n is a, t, c or g
tttgaaagtatgtaatgccactgaactctacatttaaaaatggttatgatggcaaattttatattatgtgtattttaccacatttaagtgaaaaaaaaggggggtatcatagtggacattttagcctctctattgtcctggagcgtttcttaatattactaacacgaaatatggaaaatagtatatttaatagactgaatctctgcagttatgttgaggatactcttttcatcttatctgttgattcacattttttgagagtgacctgtagaccttctctgtcagtatgaagctcagcattaatgaagtgtttatggaaattcaagcaagntgcatgcaacttgtttaattaacattcactggggcaattccatggtgtgtttttcccccttggtttgtttctcagggatctggcttgagctgtaaggtttttgagtagttcagtaacagctcgagaaatatgagcaagattatgggaatggaatgtttcctgcccttaagaaagcttatagtaaaaatgcagtgtttctcaaactttttggtctcactgctttttcacactcttaaaaataattgaaataatttttgtttatgtgggttctgtctatggagacttaccgtatgaaaaatttaaaatgaatataatattagaaattttaaa

SEQ ID NO: 1012 - DNA, 661 bp, Homo sapiens
  TNKS
  misc_feature [331]..[331]: Chromosome 8, SNP identification no. = rs13270240
  misc_feature [331]..[331]: allele = a, in linkage disequilibrium with rs6601328, respectively
  misc_feature [331]..[331]: n is a, t, c or g
taaactcataggtattgcataaatgtgtcatagctgaattttgtttcattgaaagcaatattttcattgttaagaatttttgttttgctttttattttggatgaaagtggactgataatacttaagatagggaaagtaatatttatgttatatgtatatatatatatatagcaagccattctcatattttagattctagtttttcttaatgtttctaaagataatgatgaacaagtcacatttgtcaccaagtgcctttttatctttcccaactcagcttctctgatttcctttatgtcacatattaaaagaaaaaccttagtcaaattanatttaacagttaaattgagcaaagaatgattggtgaatcaagcagcctccagagccagaataggttcagagtaattccagggctgccacatggtcagataacaattatggatagaaaaaggaagtgatgtacagaagacaaaagtaaggtatagaaagagcttggttggttacagcttattgtttgccttacttgaacacagtttgaacatttggctgcctttagctgagtctttgtgattggtacaagagtaggttacattcagtttacgtatccagttagatgtatgtatgaagaaacctttaggcctaaccttaaatatgtaaggag

SEQ ID NO: 1013 - DNA, 661 bp, Homo sapiens
  TNKS
  misc_feature [331]..[331]: Chromosome 8, SNP identification no. = rs11775432
  misc_feature [331]..[331]: allele = g, in linkage disequilibrium with rs6601328, respectively
  misc_feature [331]..[331]: n is a, t, c or g
atacctgaataaaaaaaaaatatctcccagagaaattaaagtataaagtggggaagaaatttcctggggccaaaactcaaaaccgaaataaaaaaaaaatccaccacctaatttttttttcagaggaaacaatttagtagatgaattaaagaccatgttagtagcctggaagcttacgtgtgagatgtacagagacaaatgttgaaacatggaaatcatgacgaaaaaggtaaataaatctgggaacatcaacgtcattttaaaccttacacgtgatatgagtttcagaggcaggggaaaaaagaaaaaaaagtctgatggaagagatcantaataattaaacaaatgataagaaagagaaacctatcttgagattgaaaaggctcagggagctccatatgagattgatgagaaaagataaactgagtaagatgtatattgcacttttccagaaagaaggaataagttgcctacagagggaaaaaaattaggcaaaggacttttcatttacaatattgacagcttgaagacaatggaataaccttctaaagcctgctggaagaaaaggattaagttgtaatttccttgataaagaacagttctgcagccttttgggagtaagaaaggctgaatcaagcaagtgacattacattagagaaac

SEQ ID NO: 1014 - DNA, 661 bp, Homo sapiens
  TNKS
  misc_feature [331]..[331]: Chromosome 8, SNP identification no. = rs4551359
  misc_feature [331]..[331]: allele = c, in linkage disequilibrium with rs6601328, respectively
  misc_feature [331]..[331]: n is a, t, c or g
aacaaggcgatttttttttttaggttctctttactttctcaaggctagaattgcaatttctttcagcactgctctttctctagcaccttgcgacctctactcactttgttgtgctctcagtccctagcagctattgccaaataagcctcaggggttttgtcctgcacaggtacagcccagcccagccatgtgatccctggggactccttcacagacatctggggcctgctctctgcacagatccttcttctctagtttcccatcctgcagactccagccaattcttctgccttgagtttggatttctgtcttctcagttcagtgtaaccancatgttctgctttgactcttgttgtgtttatgtggttggcaaattgtgttaggcagagagttgggtgattatggtacccatcttgtgagtttctcttctttcagggatcactgtttacaactgcagctggctactgcctgcagttagttgcttcatctattttctccaatttcataatcggttatgtcagagagggaaagctagtctgataccagttactccattatggctggaaactaaagttttatttaaaattttttcgttatatttttatttctaaaagttctgtttaattcttttatacatttgccctattattttttatagttt

SEQ ID NO: 1015 - DNA, 661 bp, Homo sapiens
  TNKS
  misc_feature [331]..[331]: Chromosome 8, SNP identification no. = rs11774818
  misc_feature [331]..[331]: allele = a, in linkage disequilibrium with rs6601328, respectively
  misc_feature [331]..[331]: n is a, t, c or g
actcctccccatctaactttggggtgatttcatcgagtccattttaaatggcatctatgtgctaaagacccctctcgttcagacctcctaccttccagtttatagctctagtgttgctctgccctcttcagaggtacatatcctactacctacttgacatttccaaatgagttgtctggatgtctcaaccttaacatggccaacacagaattctttatctccctatccaaccctattgccatgcccaccaaacttgaaccccattctttccctctcgggaaatattaccacaagctacccggttgctccagccaaaaacctacaagtcggnctttattcttctcttgttgtcttaccttgtgttcagttcatcatccagttttgttggttttacctccaaaatctattccaaatccatttttcttagttgttgtaactgccagcaaacattctgatttatactaggtctcaccaacgtgtagtctgtaggctggtttcaatgacctgtttgtttctggcctgcaatgaggtaaggggctggcactagaatataaatcaatggtatcactaagcacacctttagtttacttgacttctttttctaatagcaagacttccttgttgaaaaagcagtacattctgatgcagactcctaatcttg

SEQ ID NO: 1016 - DNA, 661 bp, Homo sapiens
  TNKS
  misc_feature [331]..[331]: Chromosome 8, SNP identification no. = rs4841186
  misc_feature [331]..[331]: allele = a, in linkage disequilibrium with rs6601328, respectively
  misc_feature [331]..[331]: n is a, t, c or g
atcatcgtaaatgaatgaaataacatatcaagaaagagattctaaaacttttctattcaattgacatttattgattgccttatgctctagaaacattctcagatctttaaaaaaattaaataattttatccagaaattctttactatatctaatgtaaagcctcctttttactgtattttctccttgacgaagcagtacatacattttcatgaccttttctaaaatcttcattcatttatagaatacctttattaatttgcttagttttaaacaaaacaagtctcaattctctcacaaggctgcttttttaaactagatattcttggctangtattagaagcctcatatctacaaatgtactgatttcaaatatctcatctaaccgttaactagttcataaagtagtttttataacattatgattataataccccaaatctttacatagctagaatcctcctgtgcttctgaaggacatcaaaagggatgtgatcttctcacgtacccagccatgtcaatcatgagccattttagggtgtgtaggctggacaacagattaagaactatctaagtcttagaataatcctgctccattgagttatgatttttgtgagtatactttcacatcatgcttataagtcataaaatgtactgatgaaa

SEQ ID NO: 1017 - DNA, 661 bp, Homo sapiens
  TNKS
  misc_feature [331]..[331]: Chromosome 8, SNP identification no. = rs4840432
  misc_feature [331]..[331]: allele = g, in linkage disequilibrium with rs6601328, respectively
  misc_feature [331]..[331]: n is a, t, c or g
tgtattttctccttgacgaagcagtacatacattttcatgaccttttctaaaatcttcattcatttatagaatacctttattaatttgcttagttttaaacaaaacaagtctcaattctctcacaaggctgcttttttaaactagatattcttggctaagtattagaagcctcatatctacaaatgtactgatttcaaatatctcatctaaccgttaactagttcataaagtagtttttataacattatgattataataccccaaatctttacatagctagaatcctcctgtgcttctgaaggacatcaaaagggatgtgatcttctcacntacccagccatgtcaatcatgagccattttagggtgtgtaggctggacaacagattaagaactatctaagtcttagaataatcctgctccattgagttatgatttttgtgagtatactttcacatcatgcttataagtcataaaatgtactgatgaaaaagaagccattggtaattattctataaaataagttatctagtgtagtagaagaaaatttactaaaaactaaactaatttggcattctatcattttgataaacactcttgtctctatttggtagacttagttatcacaatcaaatttgtcttctgctttagaatatagggaga

SEQ ID NO: 1018 - DNA, 661 bp, Homo sapiens
  TNKS
  misc_feature [331]..[331]: Chromosome 8, SNP identification no. = rs4535743
  misc_feature [331]..[331]: allele = a, in linkage disequilibrium with rs6601328, respectively
  misc_feature [331]..[331]: n is a, t, c or g
cattttggtataattttaatttctggaggcatgttaatgtgctacatattaaaaaataaaattaaattgaagatgggggaaaaacacctaaaatttgaatgtaagcagaaataaatgagccacctatatttcaaacaaccacactgaagaaagtaaagaactaatctaagtaacttttgaacgtaattctttgacttcatattcttggtgtaggaggaaagaaaagggaatttcaaaccaactttgacttcttattaagtttgttgttctttgttttttgcagtgtgtggtgtagtaattctgcaactattttatgtatgttgtaggattnagcaaataagtaaatgtgttgggagcaagggctcttactgtagaagaagaagatacaaatgtggaagggggaagacagaggagaaacttgtggatttggattgaagttgtaggcatcagaatcactgcgggaaacaaacctctatttctgctacagaaaagacctagaagcagtgagaccccaatagcagtggagcacacctgcttccaagagcttggtttctacatgccgtttattaaaagacaccaaaactttgaaaaaaaaatgactgatttcaaagctaggtcggggaaggtgtaaaaggagcctggaacatcttctgtgctagaa

SEQ ID NO: 1019 - DNA, 661 bp, Homo sapiens
  TNKS
  misc_feature [331]..[331]: Chromosome 8, SNP identification no. = rs11994018
  misc_feature [331]..[331]: allele = t, in linkage disequilibrium with rs6601328, respectively
  misc_feature [331]..[331]: n is a, t, c or g
ctaaagagacatgacaactaaatgcaaaatatatgatcctggactagaggagaaaaatgctataaaggctataataggaatgactgacaaaattggagcacatactgtatattagatgaaaagtattgtaccagtgttacttgaatttaattactgtactgtggttacatgaaaaaagtattgtttttaaaaaataggcactgaagtactaaacgcaaggagaaataatgtatcgatgtattgcagccttctcaaatggataaaaaattggttgttacatatacctatgtgcataaacataagcgagaggatataaagcacatgggcagangattataagtaggtgagatggaggatatggaggagccccttgtactaattttgcaaattttctgtttgaagttatttcaagtaaaatgttattcaaagtgatcatgctgggcataagaaagaaaaaggaaaactgattgatgttaataagttatgtggtcatgccatctatactagcttttctggttttctgaccttagacagcctcttttttgaattattagtgtttataaagagctcaagactttttttttctttttctttacattttacttctaactgcattgatggtcttttctattgattattgtttcaaaattaaatgtctttt

SEQ ID NO: 1020 - DNA, 661 bp, Homo sapiens
  TNKS
  misc_feature [331]..[331]: Chromosome 8, SNP identification no. = rs11991547
  misc_feature [331]..[331]: allele = a, in linkage disequilibrium with rs6601328, respectively
  misc_feature [331]..[331]: n is a, t, c or g
accaccatagaaaataagtattggcaaggatgaggtgaaattgggccccttgagcactgttggtgggattgtaaaatggtgtaagcactatggaaaacagtatggagactcctcaaaaaattaaaaatagaattcccatatgacccggcaattctgcttctgggtatatgctcaaaagaactggaagcaggggcttgaagtgatatttgtacactcatgttgatagcagcagcatttgcagtaaccagtaggtaaaagcaacccaggtgtccatcaagagataaaccgataaataaaatgtggtatggaatacaatggagtattaatcagncttaaacagaggaagggaatctgacacatgcatagcatggatgaaccttgaacacattttgctaaatggaataagacagtcacaaaaggacagataatgtggattccacttatggagttacttagaatagccaaactcagagacagaaagtaaactagtggttgccagggcctgaagagaggggggaatggggaattagtgtttaataggtacattttcagccttgtcagttgaagagtgctgtgaatggatcttggtgatggtagcacaacagtgtgagtatgcttaatgccactgtgtacttaaaagtggttaaggtgataaatttgg

SEQ ID NO: 1021 - DNA, 661 bp, Homo sapiens
  TNKS
  misc_feature [331]..[331]: Chromosome 8, SNP identification no. = rs7839648
  misc_feature [331]..[331]: allele = c, in linkage disequilibrium with rs6601328, respectively
  misc_feature [331]..[331]: n is a, t, c or g
ttgcttgcttgcttacttacattgcttgcattcttggtcttctcttgctcttgagatttctttttttatagtattttaaaaagatttccttgtttttttcagatagaatatatgaatgttatttttttcgcttagttcttgcatgtctttctttggcctccaaacgaataatgccttacctgcaatatattaaatataacttttttattcacctttttaaattcgaccttcagtgatctgtagttattattcttcattttctagcttgtattattgcaaatagaaatctgtttcacatctgatttcattctcatttttttggtttctaaanatttgagattttctcatttttatacagagaagtttctaatttttttgaagtcacattgtgtgattggtgacttccctaatctcataacatgttcccttttaagtggaatcaatattaaatgacatgtattaaggtttattatcagaaactcatggaatctcaaggttaaatgggaccttgaaggccatttagtccaaataatcatacagtgcatggatatttcagtaccattatcaagtaattctctcattcatgcttacataggttttttcttttccaagtcagtttagtccagcttctaggttttggtgctttgttaggtctctttcc

SEQ ID NO: 1022 - DNA, 661 bp, Homo sapiens
  TNKS
  misc_feature [331]..[331]: Chromosome 8, SNP identification no. = rs4128324
  misc_feature [331]..[331]: allele = a, in linkage disequilibrium with rs6601328, respectively
  misc_feature [331]..[331]: n is a, t, c or g
gccaattataccaacaccatttgttaactacggtgtcctttcttcaccgtatgtttttgtttgctttgttgaagatcagttggctgtgagtacttgggtttctttctgggtcctctcttctgttccaactaattgtcttttatttggagtagtacaaaattttaaataaaaataaatgaagtggggctcacttctgttggtttttttaatctttaattgtgtaatatatataaaaatagcagctaaagtttatgtttatgtattcaaccagcataataacttttactttaatataaggatagaaaatataggaaagtgattgacatatgcntatgtcttttgttgaatgccatcggtcaaagaccaccagaaacatatctgtgattaacaaagttaaatttatttcgcttgttgcctcaagggaggacacacccagaagagctttgagagaatttagaggaggacttagaaggggcttcttgtagggtctagacttgtactaaatatttctaaaagggatttgggaagctgggatcagttccagattggatactctcaagaaatagtgcaattcagtagttcagaaatatctgttcgggaggcaggaggaatgaagccaggctggtgatgtcattagtcagaaagcaagtcactaggagga

SEQ ID NO: 1023 - DNA, 661 bp, Homo sapiens
  TNKS
  misc_feature [331]..[331]: Chromosome 8, SNP identification no. = rs1393
  misc_feature [331]..[331]: allele = c, in linkage disequilibrium with rs6601328, respectively
  misc_feature [331]..[331]: n is a, t, c or g
tacttcactttttgtaagaaattggttatttttgtacaaacacataagactttgaatttgtaattacgactttaagacttataggagtaaatatagaggaaagtcaacgtttccataattttaaattaaaaaaaaacattttcgtacaaaaaaaattgtgttctttgtgagctaaaaatcaatcgtcatgatcatccaattcttatttgatatcttttatatttagatttatcttttcgtgtcatccgtacaataaaaatagacggtttacggacaatcttagaaggtcactagagagttcatactaaaccccttaacgagaggagataantctagaacactaagaccacgtcaagggttagtgtcgtggaacgaggtgaagaccgattagtagtgtgagatagacgtcttgtcactgattacgtccatatctataaaccgactttgtcgagtcttaacaaggaactttaaaaaatgacgtgttgaccctttctggagacgtcgatttcccgacaccagggtctcgacgattaccggtataaggagtttggtacttctcggattcctttgtttttggtacgtctacgtctgtcctttacctctgtgtctccgacttcagtagaccatcgtccctttcctgatctccctcgtgtcttccctt

SEQ ID NO: 1024 - DNA, 661 bp, Homo sapiens
  TNKS
  misc_feature [331]..[331]: Chromosome 8, SNP identification no. = rs11780274
  misc_feature [331]..[331]: allele = t, in linkage disequilibrium with rs6601328, respectively
  misc_feature [331]..[331]: n is a, t, c or g
taaaggaaaagaaacctcttttttgttttactgcttatttcacttctggtcaccaaaatttgcaagtttttcctaccatgagcactcttccaacagcagttaggtgtcctataatttgattctgttctaacactgtctgcttggaattaacgtcagatccagtgagttaaaggctcagtcccagaagactacaccccactttagaggctactcgctagtagtaggttgtcatctatacttcttatctgctggctgtcaattgggggttcccatgacctcttcatcaagtttaattatttgctagtggtgcccacagaactcaggaagatangtttaccagtttattataaaggaattacaaaggctgcagatgaatggccagatgaggaggtacatagggcaaggtcagtgggcaggggcaaggagcttccatactccctcccagtgctccaccttcctagcacctccacacgttcagtaacccagaaacactttcaaccctgtcccttggggtttctctggaggcttcactgtggccaattgattatatcattccctccctggagatcaggcatggggctgaaagttccacccatccagtcacatgattgtttcctctggtaccagcccctatctggagactatccaggagcccccagcc

SEQ ID NO: 1025 - DNA, 661 bp, Homo sapiens
  TNKS
  misc_feature [331]..[331]: Chromosome 8, SNP identification no. = rs13250838
  misc_feature [331]..[331]: allele = c, in linkage disequilibrium with rs6601328, respectively
  misc_feature [331]..[331]: n is a, t, c or g
gataaactagtttgatatccttatgattaagactcagaataagcaaataacttgcctaaaattttaaaactgtagtgtcaaagctaggactggaatctgtgccctttgacagtgtttttaactgaaatggtgtggagtgatttcatgaaggaagttatgtgtaagtttggccatatgtttgtggcaagattttaacaagtgcaaatgattggagcttagatcattgtcaacatgagcaaagacattcaggaaaatgcaaggtgtatttgggtaaaagtgagtgatgtagagttgatagtgtgtgttgagaaggtaaggtggaatagggaanagtgaataataaattgaataaatttagtctatatttttaaaggattttgactattcagctgtagggttgaacaccattttgtaagacaggtatggggactcatacatttatactattttgattattattattattattgaataggagaataaactaattaaagcagaaattaatgtaactgaattaagggctagagacaagggattaaggagtaatttagggattagctacaggactgttataggaggtgggtgaaagaaaaagtacataaataaattgtagcaataagaatggaaaaaagggccgggcgcggtggctcacgcctgtaat

SEQ ID NO: 1026 - DNA, 661 bp, Homo sapiens
  TNKS
  misc_feature [331]..[331]: Chromosome 8, SNP identification no. = rs13264510
  misc_feature [331]..[331]: allele = a, in linkage disequilibrium with rs6601328, respectively
  misc_feature [331]..[331]: n is a, t, c or g
tgaacacatagcatcataacctgccatgcttagagagttccctccctccttccgtcttcctttcctccttttttgttttctttttaatatatcaaaaagttctttcatgtgtactgtggtcacaaaggctgttttcttttaaagtaccggcacactttgcagaaagtcccactggttaacagcttctagaggaacacctcttttaccttttaatatccaatttaaagaatgtatgtatttgataataccctctttttttggccgatgtgtatttattgagacacctattgatggctacaattgacaccacatcagaaacaagtacaaatgnttggaaaccctgctaagtgtcaggaaatgggatgtgtatcttagatgttactcgtactaagagaggtcatattactgcctcctgcataaagcttttacaaagcttttattatatgagtgttatattgtgtttttgaaatgttttaggacattgattgaggtttttgtgttgacatttaatatattacaatttttaagacatgaaaataatatataaattttatgacataaaattatgacataaaaattttaatataggataatagagttgtatttggggccttttaccttttggattttttttttttttttttttgagcaggagtcttgc

SEQ ID NO: 1027 - DNA, 661 bp, Homo sapiens
  TNKS
  misc_feature [331]..[331]: Chromosome 8, SNP identification no. = rs13261385
  misc_feature [331]..[331]: allele = g, in linkage disequilibrium with rs6601328, respectively
  misc_feature [331]..[331]: n is a, t, c or g
aacctgccatgcttagagagttccctccctccttccgtcttcctttcctccttttttgttttctttttaatatatcaaaaagttctttcatgtgtactgtggtcacaaaggctgttttcttttaaagtaccggcacactttgcagaaagtcccactggttaacagcttctagaggaacacctcttttaccttttaatatccaatttaaagaatgtatgtatttgataataccctctttttttggccgatgtgtatttattgagacacctattgatggctacaattgacaccacatcagaaacaagtacaaatgattggaaaccctgctaantgtcaggaaatgggatgtgtatcttagatgttactcgtactaagagaggtcatattactgcctcctgcataaagcttttacaaagcttttattatatgagtgttatattgtgtttttgaaatgttttaggacattgattgaggtttttgtgttgacatttaatatattacaatttttaagacatgaaaataatatataaattttatgacataaaattatgacataaaaattttaatataggataatagagttgtatttggggccttttaccttttggattttttttttttttttttttgagcaggagtcttgctctgttgcccaggctgg

SEQ ID NO: 1028 - DNA, 661 bp, Homo sapiens
  TNKS
  misc_feature [331]..[331]: Chromosome 8, SNP identification no. = rs4570159
  misc_feature [331]..[331]: allele = g, in linkage disequilibrium with rs6601328, respectively
  misc_feature [331]..[331]: n is a, t, c or g
tgagcaggagtcttgctctgttgcccaggctggagtgcagtggtgcgatctcagctcactgcaacctctgcctcccaggtttaagaaattctctgtctcagcctcccgaatagatgggattacaggcacgtgccaccacgcccagctaatttttttgtgtttttagtagagaggaggtttcaccatcttgaccaggctggtattgaactcctgacctcgtgatccacccttctgggcctccaaggcgctgggattacaggtgtgagccaccgcacccggcctggaattttttttcacagctgctatgcaggggtcggggggttcatttccnttttcctaaagaattggaaagcttctcaaataataacttcgtagtttgtctctagttccatactttggtgagctttttttcttttaaaaaaatgttgtaacaagtctataaagattagaattattgaaaaagtaactttcttttgaaagagctggtttttatttaccttctagttaaaacattaccaaaagtttagaattgttaaccaagtagatagtacaggttgggtaaaattgtttaactgcttactctacaattttcaggtactactttttataacaatttagtagagtgttttttctcaaataactttgttttgttttaagtctg

SEQ ID NO: 1029 - DNA, 661 bp, Homo sapiens
  TNKS
  misc_feature [331]..[331]: Chromosome 8, SNP identification no. = rs13259379
  misc_feature [331]..[331]: allele = c, in linkage disequilibrium with rs6601328, respectively
  misc_feature [331]..[331]: n is a, t, c or g
agcttaataatacataccagatatacaattcattttatacacacatacagaaacaggtaattttccttggactttttgtaattttggaagcctgtgtaaattagtctaccagattatattattcggcctgtaaacatgggagttcaataaaattaatcatcagaaacacagtttaagtagcttgtaacctcactggggagaagcttgaaattattccgtgcttttgggttaacttaacaaaaattgctgccttttttcaacatatagcctttgaataagggagataaattactaggtttggttttgttttaggtgattttgataataccangagtggtacctctgttttcatcttttgtgttagaaaatttaaaaataattaagctatagaattaattttatagtgatattataatcccagaagaatcacaaaacatcctgttctgagaagacttagtctgattatgctgcttatttattttattttttgtttatggggttttttgttttgttttgttttgagatggaatctcactcttcacccaggctggaaagcagtggtgcaatcttgactcactgcaatctccgtctcccagattcaagcgattctcctgcctcagcctcccaagtagctgggattacaggtgtgtggcgccacacc

SEQ ID NO: 1030 - DNA, 661 bp, Homo sapiens
  TNKS
  misc_feature [331]..[331]: Chromosome 8, SNP identification no. = rs4289816
  misc_feature [331]..[331]: allele = t, in linkage disequilibrium with rs6601328, respectively
  misc_feature [331]..[331]: n is a, t, c or g
gtgccttacttgaagaaacttttgctgatggagaggctgggaatggtgaataattttgttttctaagctagcaaatgttaggtgaatacatttccttaaagagaactggacagttcctttctctcttcctgtaccttatcatgggcagataaacacaccagtccagttgacaaggcagaatttgttctggaaatttccttagccaaatttacaaatttatttaggtttacgttctaccttccgtaagacctcctgtggcagcgttgccaaactttctgctacacagcattagtcccctttctctcgccttcagtagcacttgcctatctancttccattcacagcctccctcagcaataaccaggccacccttcacgcctccaaccaaagccacatgtccaccagcaccccacttccaggtactggtgtgcatttcatttctctattgctgcccactaagccacccccaaacccactgagggtttaacgtgacaatttattatttctcacacgtctgggagttgactgggctcagctgggtggttctggttttgcagttacctgcacctgggaactcagcagaggctggagcttccaagatggcctttcatcccgcagggctctccctgcataggatctcaccactcagtagtctagccca

SEQ ID NO: 1031 - DNA, 661 bp, Homo sapiens
  misc_feature [331]..[331]: Chromosome 8, SNP identification no. = rs17734024
  misc_feature [331]..[331]: allele = g, in linkage disequilibrium with rs6601328, respectively
  misc_feature [331]..[331]: n is a, t, c or g
tggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaaatgatcctttatagttcttacacttgcccttttcaccttaactgaatatgaattgagtgcactaacttatttacttgatatactgtgcatctactctgctttgaagcnaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgaccc

SEQ ID NO: 1032 - DNA, 661 bp, Homo sapiens
  misc_feature [331]..[331]: Chromosome 8, SNP identification no. = rs421844
  misc_feature [331]..[331]: allele = t, in linkage disequilibrium with rs444772, respectively
  misc_feature [331]..[331]: n is a, t, c or g
tttttaacatcattgtcaaagtaatccttggaagtgtgagatcattacttctcttctcaaaatccttccttggtttctcatctcacttaaagttaaagccaaagtatttaccaacggctacagaccctgtataatttggtgccctgctttctagccacactggtcttcttataatttctcaaatacttcaaatacttcccacaaacctttgcacttactctctctgccaggaacacacttctgtcaaatatctgaacaccatttcccctgactacttttagatttcttctcacgtcacttctcagtgaggttttccctgacctctaccacngccactcctactttacctcacttttctccatagcactttataggatctaacatgctgtagatttgctttttttattcatagtttgtctctgcaggataatgtgaccccatgaaggcaaggatttttttctgttgtgtttgttgctatgtgtgtctaatacacagtgagtatgcattaattatctgttgaacaaataaacaaatgagtaaagaaggaaggggaatgggtttttacagggaatggttttttaaggtagaggccatttaggttcaatatccaataatttaacttcatcagaatggaccatacacagaattctatgtggcttgg

SEQ ID NO: 1033 - DNA, 661 bp, Homo sapiens
  misc_feature [331]..[331]: Chromosome 8, SNP identification no. = rs435326
  misc_feature [331]..[331]: allele = c, in linkage disequilibrium with rs444772, respectively
  misc_feature [331]..[331]: n is a, t, c or g
ccataaaaggtatacaaaattattatgcttcctgatatagtctgatctctgtcctgggttccttgggcctgcctggaaaggtaaattctagcagttacaatgagacagcattcttcaggcatatatatctccacaacaattctgtactaaggcaggcagaggatcattcctttaataggtatttattaagtgcctgatatatataaggtattgagctgtttctggaaattcagagatgataaagaagttacacttctggtgcttgatgcaccagttgtttgtgcagtatgaaatgtatagagagtatatttatacagatagataagggggnatattggagggtacttacttcattcagcgtgttgatgtagtgggaaggcaggggttcaagaaaggtttctgagatgaactgagtgtggaaggaagggacagaaaatgtatggcaatgaaaggcagggtgtctgggttatgaggaggcattccaagtaagataaacaatatatgcaaaaatctagagccacatttaaaaaacttcaaataatcaaaactacagagtaagacatatggatcgaaatgaaattggaaaagtaagctgaagtcagatcacaatttttgaggcatgctagggcatgaagtcatttactaaatgctgtgaggatca

SEQ ID NO: 1034 - DNA, 661 bp, Homo sapiens
  misc_feature [331]..[331]: Chromosome 8, SNP identification no. = rs396881
  misc_feature [331]..[331]: allele = g, in linkage disequilibrium with rs444772, respectively
  misc_feature [331]..[331]: n is a, t, c or g
ggcctgcctggaaaggtaaattctagcagttacaatgagacagcattcttcaggcatatatatctccacaacaattctgtactaaggcaggcagaggatcattcctttaataggtatttattaagtgcctgatatatataaggtattgagctgtttctggaaattcagagatgataaagaagttacacttctggtgcttgatgcaccagttgtttgtgcagtatgaaatgtatagagagtatatttatacagatagataagggggcatattggagggtacttacttcattcagcgtgttgatgtagtgggaaggcaggggttcaagaaagntttctgagatgaactgagtgtggaaggaagggacagaaaatgtatggcaatgaaaggcagggtgtctgggttatgaggaggcattccaagtaagataaacaatatatgcaaaaatctagagccacatttaaaaaacttcaaataatcaaaactacagagtaagacatatggatcgaaatgaaattggaaaagtaagctgaagtcagatcacaatttttgaggcatgctagggcatgaagtcatttactaaatgctgtgaggatcatggaagtgtgttaaaagaagataaacatggcaaaaataataatgtccatttactgaacacttgtt

SEQ ID NO: 1035 - DNA, 661 bp, Homo sapiens
  misc_feature [331]..[331]: Chromosome 8, SNP identification no. = rs446102
  misc_feature [331]..[331]: allele = c, in linkage disequilibrium with rs444772, respectively
  misc_feature [331]..[331]: n is a, t, c or g
ggttcaagaaaggtttctgagatgaactgagtgtggaaggaagggacagaaaatgtatggcaatgaaaggcagggtgtctgggttatgaggaggcattccaagtaagataaacaatatatgcaaaaatctagagccacatttaaaaaacttcaaataatcaaaactacagagtaagacatatggatcgaaatgaaattggaaaagtaagctgaagtcagatcacaatttttgaggcatgctagggcatgaagtcatttactaaatgctgtgaggatcatggaagtgtgttaaaagaagataaacatggcaaaaataataatgtccatttantgaacacttgttatgacattcagacactgtgtcaaacacataatgtatattctcttacttaaccctcaccaatgagcctataaagcaggtacttttccacattttatggccagggaagtagacagaggaattaagtacatggcttgcagattcacatagcaaagtggaagaggcaggatttgaactgaggtctgactgactcagtggtatgctgagaatgtatgcttaacaccactcctgtcatctggccactctaacagcagtgactagacagaacttaacagagctcagatatgacatacaggtaatctcagaggccatggcaattga

SEQ ID NO: 1036 - DNA, 661 bp, Homo sapiens
  RP1
  misc_feature [331]..[331]: Chromosome 8, SNP identification no. = rs702761
  misc_feature [331]..[331]: allele = a, in linkage disequilibrium with rs444772, respectively
  misc_feature [331]..[331]: n is a, t, c or g
gctggacatactgagaataaatccaaagacattagtttctttgcacgaaatgaggttacatatccagtgacatttatttgagctatttaaacaacttaaacatctttttcttttcttaataagggacgtttcaagttgtggtaagtacaaaactatttgaaatctttctttggaaaatattctgttttgctagttgtattttgttttccatgttatacttagattatatatctgtgttctgtctttaactgttagaaaaagcataaatgttattaataattatcttttacctaactatgccagcaaccttcacaatatgctgatattgaantagaatggaacttcagtatcaggaaatcaagtgattctagtttattcaaatgagtaatgtttactttgtttctgacaataaaagcattatatacttcttatagacatctaggcaatacactaaagaagaagacagctgcttgtaattcaacaatgctgtgactaccacagtgaataactggtgattttcctttttgaatctcctctctcaactctgccccataggcttatgaaaatctgaaatgaactgatttttcttgcaacatcaagtctctgaattgctaaaagaatgaacattctgtacattctgtatttctcaattttccatttt

SEQ ID NO: 1037 - DNA, 661 bp, Homo sapiens
  RP1
  misc_feature [331]..[331]: Chromosome 8, SNP identification no. = rs145290
  misc_feature [331]..[331]: allele = a, in linkage disequilibrium with rs444772, respectively
  misc_feature [331]..[331]: n is a, t, c or g
ttttctacttcattatttgtgacttgtctgaattcacactatgtggtagaaaattaaacttaaaatataattagtgaaatgacgcatgtactctgtcatgtttttgtcaagtgagtgagagagtgaagacacagccctcttggtagaggccaactatttagttctgagcagcacagctgtaaatgattgttttaagtggggtttgtttgaaactaatgatgccacagataagcctagccacagttgagcctaagggtgttaaaaaatctgcttaatattaaagagcaatgaaagtatgcatgatagctccattgtctaactttaggcaatnaagagtctctgcagagaagaagagacgatattggtagcaagctgtcatgtcattagaagcggattttaaggcaaaaagtttttgtaaaccagcttccttgctacatataaggaagtcactggtgaagaaactggagggcctcaagattctacagttacctctttccacctccaccacttcttcagcctaaacttctgggagaattcaaccattttatgctgctcagtttgttcgttccctaggtagcccttaagtatattactgccttattccaaatttaaagggcataagatacaccttattatcgaaaatgtatgtaaagatacattg

SEQ ID NO: 1038 - DNA, 661 bp, Homo sapiens
  RP1
  misc_feature [331]..[331]: Chromosome 8, SNP identification no. = rs428854
  misc_feature [331]..[331]: allele = g, in linkage disequilibrium with rs444772, respectively
  misc_feature [331]..[331]: n is a, t, c or g
tttctttttgagatggggtctcactatgttacccaggctgttatgatgggctcaagtgatcacccgcctcagcctcccaaagtgctgggattacagatgtgagccattgcgtccagcccaggcattttgactgaatttaagaagcaagagtgccaaggttaatgctgaagatacatgttaaaaagataactgatatctggacttatgtctagctctgttctctcttgtgccctatattaagtcagctgcaacgattatacaaagtgcatgctaaataattagtacttgattaattcagtctgaatcataaaatgtttctgctttcataaanctatggatacctgttttgatatgtgtaggtgggaagatgaataccatcataaattgttggctgccttgtttgaataggtaagcggtatttggttagactccagtttcagtactggtaaacaaaacaacgaaatgaaaacccacaaaaaacttttatctttggtagaattcttagcactttttactttatacatttttaaaattaaaattaccttattaaacttgttaaaattctctgaacctccacattgaaattgaggtagaattagagatctcttctaaagagtggtttgaagaaatgtaccactgttatagtaggttttctcaaata

SEQ ID NO: 1039 - DNA, 661 bp, Homo sapiens
  RP1
  misc_feature [331]..[331]: Chromosome 8, SNP identification no. = rs429668
  misc_feature [331]..[331]: allele = t, in linkage disequilibrium with rs444772, respectively
  misc_feature [331]..[331]: n is a, t, c or g
tcctggccaacatggtgaaaacctgtctcgattaaaaatacaaaacaattagctgggcatggtggtgcgggcctgtagtcccagctattcgggatgctgaagcaggagaattgcttgaaccctggaggtggaggtagcagtgagcccagatcacgccactgcattccagcctggtgacagagcgagactctgtctcaaaaaaaaaaaaaaaaaaaaaaaagaaaaaaaacaaaatacatagagctcagaaacatatcagtaacattttactatgaaatacagaaaatatgctacttttcatactaatcatttccccttttctctttctttntttgctgcctcttcctttggatatttctaacttctctgccttccatattatattttgatgtgggcaccttttactcttaaaatctttaaagtaagcacacatatgtcttcaagctcaaggtcccagatttattctgtttcttctgagaaaacacataataatgattgctacttagactattcttttgttcctgaaaagtacttggccttagaaaagaatgattctcagaatttaccaatatatccttctgaagatgatattgagaaatcaattatttttaatcaagacggcactatgacagttgagatgaaagttcgattcagaataaaa

SEQ ID NO: 1040 - DNA, 661 bp, Homo sapiens
  RP1
  misc_feature [331]..[331]: Chromosome 8, SNP identification no. = rs444772
  misc_feature [331]..[331]: allele = a, g
  misc_feature [331]..[331]: n is a, t, c or g
taaatactactcaaaattccaaggttcaaggacttttaaccaaaagaaaatctagatcactaaataaaataagcttaggagcacctaaaaaaagagaaatcggtcaaagagataaagtgtttcctcacaatgaatctaaatattgcaaaagtacttttgaaaacaaaagtttatttcatgtatttaacatccttgagcaaaaacccaaagatttttatgcaccgcaatctcaagcagaagtggcatctgggtatttgagaggaatggcaaagaagagtttagtttcaaaagttactgattcacacataactttaaaaagccagaaaaaacntaaaggggataaagtgaaagcaagtgctattttaagtaaacaacatgctacaaccagggcaaattctttagcttctttgaaaaaacctgattttcctgaggctattgctcatcattcaattcaaaattatatacagagttggttgcagaacataaatccatatccaactttaaagcctataaaatcagctccagtatgtagaaatgaaacgagtgtggtaaattgtagcaataatagtttttcagggaatgatccccatacaaattctggaaaaataagtaattttgttatggaaagtaataagcacataactaaaattgccggtttgac

SEQ ID NO: 1041 - DNA, 661 bp, Homo sapiens
  RP1
  misc_feature [331]..[331]: Chromosome 8, SNP identification no. = rs446227
  misc_feature [331]..[331]: allele = g, in linkage disequilibrium with rs444772, respectively
  misc_feature [331]..[331]: n is a, t, c or g
gtaaaaatgatggtgaaaactatggaaactggaagttattcagagtcctctcctgatttaaaaaaatgcatcaaaagtccagtgacttctgattggtcagactatcggcctgacagtgacagtgagcagccatataaaacatccagtgatgatcccaatgacagtggcgaacttacccaagagaaagaatataacataggatttgttaaaagggcaatagaaaaactgtacggtaaagcagatattatcaaaccatctttttttcctgggtctacccgcaaatctcaggtttgtccttataattctgtggaatttcagtgttccaggaaancaagtctttatgattctgaagggcagtcatttggctcttctgaacaggtatctagtagttcatctatgttgcaggaattccaggaggaaagacaagataagtgtgatgttagtgctgtgagggacaattattgtaggggtgacattgtagaacctggtacaaaacaaaatgatgatagcagaatcctcacagacatagaggaaggagtactgattgacaaaggcaaatggcttctgaaagaaaatcatttgctaaggatgtcatctgaaaatcctggcatgtgtggcaatgcagacaccacatcagtggacaccctacttgataataaca

SEQ ID NO: 1042 - DNA, 661 bp, Homo sapiens
  RP1
  misc_feature [331]..[331]: Chromosome 8, SNP identification no. = rs414352
  misc_feature [331]..[331]: allele = t, in linkage disequilibrium with rs444772, respectively
  misc_feature [331]..[331]: n is a, t, c or g
aaatgcatcaaaagtccagtgacttctgattggtcagactatcggcctgacagtgacagtgagcagccatataaaacatccagtgatgatcccaatgacagtggcgaacttacccaagagaaagaatataacataggatttgttaaaagggcaatagaaaaactgtacggtaaagcagatattatcaaaccatctttttttcctgggtctacccgcaaatctcaggtttgtccttataattctgtggaatttcagtgttccaggaaagcaagtctttatgattctgaagggcagtcatttggctcttctgaacaggtatctagtagttcanctatgttgcaggaattccaggaggaaagacaagataagtgtgatgttagtgctgtgagggacaattattgtaggggtgacattgtagaacctggtacaaaacaaaatgatgatagcagaatcctcacagacatagaggaaggagtactgattgacaaaggcaaatggcttctgaaagaaaatcatttgctaaggatgtcatctgaaaatcctggcatgtgtggcaatgcagacaccacatcagtggacaccctacttgataataacagcagtgaggtaccatattcacattttggtaatttggccccaggcccaacgatggatgaactct

SEQ ID NO: 1043 - DNA, 661 bp, Homo sapiens
  RP1
  misc_feature [331]..[331]: Chromosome 8, SNP identification no. = rs441800
  misc_feature [331]..[331]: allele = a, in linkage disequilibrium with rs444772, respectively
  misc_feature [331]..[331]: n is a, t, c or g
cgaacttacccaagagaaagaatataacataggatttgttaaaagggcaatagaaaaactgtacggtaaagcagatattatcaaaccatctttttttcctgggtctacccgcaaatctcaggtttgtccttataattctgtggaatttcagtgttccaggaaagcaagtctttatgattctgaagggcagtcatttggctcttctgaacaggtatctagtagttcatctatgttgcaggaattccaggaggaaagacaagataagtgtgatgttagtgctgtgagggacaattattgtaggggtgacattgtagaacctggtacaaaacanaatgatgatagcagaatcctcacagacatagaggaaggagtactgattgacaaaggcaaatggcttctgaaagaaaatcatttgctaaggatgtcatctgaaaatcctggcatgtgtggcaatgcagacaccacatcagtggacaccctacttgataataacagcagtgaggtaccatattcacattttggtaatttggccccaggcccaacgatggatgaactctcctcttcagaactcgaggaactgactcaaccccttgaactaaaatgcaattactttaacatgcctcatggtagtgactcagaaccttttcatgaggacttgctg

SEQ ID NO: 1044 - DNA, 661 bp, Homo sapiens
  LOC392223
  misc_feature [331]..[331]: Chromosome 8, SNP identification no. = rs388912
  misc_feature [331]..[331]: allele = a, in linkage disequilibrium with rs444772, respectively
  misc_feature [331]..[331]: n is a, t, c or g
tttttgctacactaggcattcagtacccgtatcctttagttctgggaatttgttttatattatttctctgatctttcccctccgttttttgttctttcattttaaaatttctattatgaatattacctgagcttgatgaacctctggaataattccttaatttttaattttcttctctctctctctctctctctctctctcggtctctctcaccctttatttgggtataatttacatttgataaaatctccccaattttaagtgttatgatttgatgggttttgacaaatatatgtattcacataatcaccactatagtaagataatggancatttccatcactcaaaaaaggactttttatttccctttatagccagtcccttctcccctttgcccaacccttggaaaccatggattcactttctgtggctgtagtgttttctctagaattttatgcaaatggaatcttatggtctggcatctttgatatctgcttcttttacttagcaaaatgattttgagattcattattgttgcctgaatcagtagttgtttttcattgctgagtggtatttcattgtatgtacataccacactttgtttatacatttaccagctaatagacatttatttctggcttttggttattatggatataag

SEQ ID NO: 1045 - DNA, 661 bp, Homo sapiens
  LOC392223
  misc_feature [331]..[331]: Chromosome 8, SNP identification no. = rs376055
  misc_feature [331]..[331]: allele = c, in linkage disequilibrium with rs444772, respectively
  misc_feature [331]..[331]: n is a, t, c or g
ggaggttgagcatattttctatttcttgatcacttgtgttctctttttttttaataaattgcctattcatattcctgtccatttttccattgtgatatcgatgttttgtttagttttgttttattgattgtatgaattatttgcaaataaaggaaatttgtcctttttcatttgtgtggcagtttaaaacaattttaccatttgggttataacttttacaagttttgtttattaatgttgaaaaaaatcaacttattgaggtataatttacataaagagatgtatgcattttaaatgtacaatgtgatgagttttaacagttgtgttcacntgtataattaccatctcaatcaagatacagaacaattctatcccaaatagtttcttcatgttctctgaagataattccaccattcctggccctaggaaagaactcatttgcttttagttatacaaataagcttgcctttttctagcagttcttctgtggaatcataaagtatatactcctctgactagggttttgatcatcatgaagcttaagattcatccaagctgttacatctattagtagcttgtgccttttaattgctgagttgtattcattatgtaacacattttacctgtagagtcacctcttgtttgctggggcttctgtaac

SEQ ID NO: 1046 - DNA, 661 bp, Homo sapiens
  LOC392223
  misc_feature [331]..[331]: Chromosome 8, SNP identification no. = rs448744
  misc_feature [331]..[331]: allele = c, in linkage disequilibrium with rs444772, respectively
  misc_feature [331]..[331]: n is a, t, c or g
gctctatctcattgtggttttagcttatttacatttctctaatgaggaatgatcctgagtatcatttcattttctcctgtgttctgttaatatggtgaattacattgattggctgcttaatgttaaaaaacttgcatttctggaataaacttgaagattatagttgatgtggttttctaatattttgttgagaatattttcattgatgtttttgggggttattgctctgcagttttcttataatgtgttttctgatttgggtaccagagtaatatgcttctcatacaatgagttgggaactattccaaatggtttatataggattgatacnattttttagaatagtttgatacaaaattcaccactgaagccatctgggcctgaagttctttgtgaaaaatatttacagtataaatttattgttttttttagaggatataggattattcaaattttctatttgttttgtgtctgctctggtaaattgagtctttccccaatctgtttgctcattaaatgactaaattgtttatataaagaaaaaaggagctgtttgtccaccacccgcattctttttttctccagttcatctactcaccccttcaactcactctttttcaaatcgaggcctagtggtatatgtatattacaaagacttaga

SEQ ID NO: 1047 - DNA, 661 bp, Homo sapiens
  LOC392223
  misc_feature [331]..[331]: Chromosome 8, SNP identification no. = rs433265
  misc_feature [331]..[331]: allele = t, in linkage disequilibrium with rs444772, respectively
  misc_feature [331]..[331]: n is a, t, c or g
tgagtcttccatttctatcagttgccataatgctgtatgttattttttcttttataggtagtaactggaaagtttttataatcaccagtgacttgccagatgcagggaccagctcacagatttatattattctgtatggacaacatagaagttcagcccccatatatctttatggaacagatggggctcgatttcaggttggccatgaagacatatttactgtaagtaataaaactgagtataaactgttaatataagtgatacacctagtaggtactttggaatgaacatagtctatccctttagtaacaccatgtgccctgtagaagancattcaaaaataatttatggaagtttttgctcaagcagatttaacacaagtaaatctgcaatatgggaagagacagtagctagagagaaatactagatggtaaacacttatttttatgtggacagacatcaggagcaagggcttatgcctttctggctctccagataaggctcaaagtcaagctcaaaaagggaaaaataaaattgtcaaacaaggaaggcaaaaaagttgtcatcaagttgttaattactggtttttattaggtattagttatcaagttattagaccatggctagacacatggagatcagggtctagagggaaacagag

SEQ ID NO: 1048 - DNA, 661 bp, Homo sapiens
  LOC392223
  misc_feature [331]..[331]: Chromosome 8, SNP identification no. = rs421469
  misc_feature [331]..[331]: allele = g, in linkage disequilibrium with rs444772, respectively
  misc_feature [331]..[331]: n is a, t, c or g
ataagtgatacacctagtaggtactttggaatgaacatagtctatccctttagtaacaccatgtgccctgtagaagatcattcaaaaataatttatggaagtttttgctcaagcagatttaacacaagtaaatctgcaatatgggaagagacagtagctagagagaaatactagatggtaaacacttatttttatgtggacagacatcaggagcaagggcttatgcctttctggctctccagataaggctcaaagtcaagctcaaaaagggaaaaataaaattgtcaaacaaggaaggcaaaaaagttgtcatcaagttgttaattactgntttttattaggtattagttatcaagttattagaccatggctagacacatggagatcagggtctagagggaaacagaggtaacaaagatgaagcagggagaccagtgccatgttgttaaactgaagtcagatacattagcaaacaaaggcaagacttgaagtgggtcaagcacctggcacttacagatgcttagtaatgtctgttgaataaattaatggatgcacagaaggattggtttgaaccaggtggagacagagtaaaatcaccatgaaaaaagagtctccttaagtattgcaagtcttcacaggacagccatctccatgtgatcct

SEQ ID NO: 1049 - DNA, 661 bp, Homo sapiens
  LOC392223
  misc_feature [331]..[331]: Chromosome 8, SNP identification no. = rs383666
  misc_feature [331]..[331]: allele = a, in linkage disequilibrium with rs444772, respectively
  misc_feature [331]..[331]: n is a, t, c or g
atagtcactaaaaggaaaagattttgtcattattttctgtgagtaagaaataaaaatagtctgagctgttgttgttttactattttagtgtttcatgttttcttttaaattgaattatatattcacatagtttatagggctaaataattttcaattctgtaataagaaaggaacacccttaacccctcatttttatagtttgatgcttcttttttctgaatgctgctactaaatttcagctctttctgttgtcactcttgcctgagttctgggatggctacattaatctcttgttgtagaggtgatggctttattaaatgcagtaatttcntgccaattttgatcacagtttcgtttgttctaatgaattgttttcttgtaagggttcttaggcagactgttttacatcttcctttcctttttccctgtactttctttgtatagaccttttcttttcttttttattatggtaaaatacacaaaagttaccattaaaaaatttttaaattgtacaatttagtggcatatagtacattcacagtgttattcaacaatcactatctactttcataacattttattcactccaaaagaaaactttgttatgcagtcactccctgttgcctttctaccaacccctagcaacctctgtcttgtcttc

SEQ ID NO: 1050 - DNA, 661 bp, Homo sapiens
  LOC392223
  misc_feature [331]..[331]: Chromosome 8, SNP identification no. = rs509273
  misc_feature [331]..[331]: allele = g, in linkage disequilibrium with rs444772, respectively
  misc_feature [331]..[331]: n is a, t, c or g
caattcttataatacagtttagaagtttgaaatttgaaattttaattaatcaacttgtatggggatttgaacagaatcactgattccatgatagcaacaataatacatttccataaaataaccacattgctttagaaacttaatcttgatttttttcaagtttagttagggaagattacaaaataaaaagttcaaaatgttaggttattttctgcttctcaaatgatcagctttgggccttaattaaaataatcaaatcagacagtcttggcagtaataaccttgcaaacaataatttttctcatgggttctcaggaagcctttctaaaantgacattacattgtatcagaatcacacttaacatgcatttataaatgtgaattcctgaacctgtctgagtctcacagaccttagtaggatcaggtactgaaaatctgactttttttcctttttgagacagggtctctgtctattgcctaggctggagaccagtagcacgatcatggctcactgcagccttgacttcccaggctcaagcgatcctcccacctcagcctcccaagtagctgggactataggcatgcaccaccacacctggctaattttttattttttgtagagacagggtcttgccatgttgccctggttggtctcaaactc

SEQ ID NO: 1051 - DNA, 661 bp, Homo sapiens
  LOC392223
  misc_feature [331]..[331]: Chromosome 8, SNP identification no. = rs428630
  misc_feature [331]..[331]: allele = g, in linkage disequilibrium with rs444772, respectively
  misc_feature [331]..[331]: n is a, t, c or g
gccttgggggagaacgggataagggcatacgagattattaaatagacaattggcaaaaaatggatttttctccaatccagactatgttctgttaaaaatgtgatgttttaattttctgaataaataaataaatgagtaatattaagtcttatctgacattaggcttaggtccataccaacctgtgtagttttttgagggaacatagactggtaaacatttgcacagattgatgattcctttgtggttttaaataaggtgtgatcacttttcttaagtttctgaagttaaaatatttttgaaaagacatgaatagccctagttactgaaaantgaagcaggagcattgttctcaccattcataagtatttttttcaccatttagaagcattgttatcactattcttcctcatcagcccacacgtttcacctgagaagatgttcgccaggtgccctattcctacccattgttagtaacaatgcagaggtgactttctgctgctacttccctccattttaactgttaaagttctgctcaaagaaggcacactctacaaatatgttctgattttacttgtcttctgtgtagggcttgacccttatggtttattaataaacatttttcttttcagtttcaggacatggcttggtattctaaccata

SEQ ID NO: 1052 - DNA, 661 bp, Homo sapiens
  LOC392223
  misc_feature [331]..[331]: Chromosome 8, SNP identification no. = rs369565
  misc_feature [331]..[331]: allele = c, in linkage disequilibrium with rs444772, respectively
  misc_feature [331]..[331]: n is a, t, c or g
tatgatttggttccgtcgttttctatacatgtcacttttgatgttttgcaacaattttatttctttgtttatttacctttctgtggggttcaaacatccaatcttctgaattataacaattttacagatggaatgggtttcgttagatttctaatttacgtcagggatagttttagagttgtcgttaaaaatgtctttatccttttttaggtttttaagtacatctaacggttctctagggacttatcagttttgttagaactttactagtttcaatattcggagtgtgaagaactaaaattatgtatactgtttcgttgtcattatttcngtcacaccatgaccctatttctatctgtctgattatcttatcttatctcttgagtcttttttcgggagctaatatgtcactttactaaaactgttcccacggttctggtgtgttcctccttctgtcagagcagctatttaccacaactgatttgacctataggtgtacgtttttttatttatttatttcaacttagaaatagaatgtagttatatctataactgatttttacataatttctggattggtatttttagatttatgtattttgaggatctactttagaattctcttttggaagtcctatagtttaaaccgtcaataaagaac

SEQ ID NO: 1053 - DNA, 661 bp, Homo sapiens
  LOC392223
  misc_feature [331]..[331]: Chromosome 8, SNP identification no. = rs858428
  misc_feature [331]..[331]: allele = g, in linkage disequilibrium with rs444772, respectively
  misc_feature [331]..[331]: n is a, t, c or g
taattttgttctttttgtttattttctattggttgaaccttctcttcttcgttctaatagcgacaaacgtccaatatatacatcttttgagattttcggaggtgtgttttttttaacaattttgttgttttagttgtgagtttttcgtcgacgcaatgatatatgattgtttcttattatgtttttctttaattcttttgttaacgtaaatgttatcgtggtttttgttattttatgatatgaattatgatttggttccgtcgttttctatacatgtcacttttgatgttttgcaacaattttatttctttgtttatttacctttctgtgnggttcaaacatccaatcttctgaattataacaattttacagatggaatgggtttcgttagatttctaatttacgtcagggatagttttagagttgtcgttaaaaatgtctttatccttttttaggtttttaagtacatctaacggttctctagggacttatcagttttgttagaactttactagtttcaatattcggagtgtgaagaactaaaattatgtatactgtttcgttgtcattatttccgtcacaccatgaccctatttctatctgtctgattatcttatcttatctcttgagtcttttttcgggagctaatatgtcactttac

SEQ ID NO: 1054 - DNA, 661 bp, Homo sapiens
  LOC392223
  misc_feature [331]..[331]: Chromosome 8, SNP identification no. = rs499324
  misc_feature [331]..[331]: allele = a, in linkage disequilibrium with rs444772, respectively
  misc_feature [331]..[331]: n is a, t, c or g
ttatttttacttgactttaaaagaattaactgtataaatgggtcccaagatgacccatttgactttatgttttatcaacaaagtaatttttcatgggtatcccgtagtcgttttacgtaaacgggtgtctctgtggtagtattgttgttacgaaccttgtaaacggaaacactcttggggtctttggtggattctccaaggacgtgggtccgttcgggtttctgtttttcttggagtagtttcagtcatccttttaagtaccgtaaaatgtacgacttcgagggggaggatgggggtcgtgtatgtcgtactggttcaacgtaaatatggntctatatgttcctaccaaggtgtatacttttagttagttacattgtacggtgtaattgtcttactttctgttttttgttttttgaagtagttacgtctttttcgtaagaatattaggttgtaggaaggaactattttcgagagttgtttgatccttttcttcctttgatagagttgtattattaccgttatatatttttcgagtgtcgattgtgttatgaataactactttctttttttgaaaaggagattctagtactttttctgttcctacgggtgagagtagtaaagataagttgtatactgactttcaagatccataacgttaatt

SEQ ID NO: 1055 - DNA, 661 bp, Homo sapiens
  LOC392223
  misc_feature [331]..[331]: Chromosome 8, SNP identification no. = rs409429
  misc_feature [331]..[331]: allele = a, in linkage disequilibrium with rs444772, respectively
  misc_feature [331]..[331]: n is a, t, c or g
taaagtaaaaaggaaaaaatttttggtttattgatacgatttcaacctctctcttttgttcgcctccccctagtctcattgtcaccagatagtggaaacacgataagattagtctccataagaagaaaataaaaggtacattcttgaattttctgtttatatattatttttacttgactttaaaagaattaactgtataaatgggtcccaagatgacccatttgactttatgttttatcaacaaagtaatttttcatgggtatcccgtagtcgttttacgtaaacgggtgtctctgtggtagtattgttgttacgaaccttgtaaacgganacactcttggggtctttggtggattctccaaggacgtgggtccgttcgggtttctgtttttcttggagtagtttcagtcatccttttaagtaccgtaaaatgtacgacttcgagggggaggatgggggtcgtgtatgtcgtactggttcaacgtaaatatggatctatatgttcctaccaaggtgtatacttttagttagttacattgtacggtgtaattgtcttactttctgttttttgttttttgaagtagttacgtctttttcgtaagaatattaggttgtaggaaggaactattttcgagagttgtttgatccttttcttcctttg

SEQ ID NO: 1056 - DNA, 661 bp, Homo sapiens
  LOC392223
  misc_feature [331]..[331]: Chromosome 8, SNP identification no. = rs426380
  misc_feature [331]..[331]: allele = t, in linkage disequilibrium with rs444772, respectively
  misc_feature [331]..[331]: n is a, t, c or g
cttttctcttacctctgtagtggtaactctactgtgcccatgactaatagaccgtttctaaaatttcgtcagtcctatgtttacaatgatgtttgttcgtacttgtgagaattttggttacctctttatcttttaggagtgtttctttatcttttaaatttcttcttgatttatctttaaaatcttgactttttttcgtagtatttgtttaaaattttgagtgacttctccgagttctcgtctgacctctcttgtctcctttcgtgtttactcgaacttctgtctatttatctttagtaggttagattgttgtgtctttttatgaaaaaantttttttcttggagtccctggacatcctattattattttatggactataagtacccgcacttcatggtcttcttctctttttctaagattaagttcttaaggcacttaagtttgtgccaagacgtgacgggagggtgtggtcgaggtaggagacctaaaagtgtagtcaactataagaaagtataaggtaagggaggagtcgagtacgtcttccaaatattcatccttgataactcccttcaaaataaatgaaagaccctaacatttgaactgttaggaaaagatttcttagatttctaaagaaaaaaaaaattatgtcctagaccaaga

SEQ ID NO: 1057 - DNA, 661 bp, Homo sapiens
  LOC392223
  misc_feature [331]..[331]: Chromosome 8, SNP identification no. = rs439539
  misc_feature [331]..[331]: allele = c, in linkage disequilibrium with rs444772, respectively
  misc_feature [331]..[331]: n is a, t, c or g
cctgcctcctgaaccagaactagagggcttctaccgagcccccatatctgaggtcccagtacctatttccaggtctctggtgcattgaatccaggctgggggactgcggaggaggaaaaatggtaaactcacagatgcttggtgttactttaaatgttggtcttcttccccattcctcctgctgctgttcatgttttgatcttcatatagctgttctatgcattctgtcaaagttttatagctgcattcagtaggagagactggatggtgtgggttactccatattacctggaactagaactcttgattggatttctgtacagtagtcccngcttatccatggtttttctctccttgatctcagttcttcaaagtcacttgctgtccaaaaatattaaatgtaaaattccagaaacagacaattcataaattttaagttatgtcccattctgagtgtaatgaaatcttctgctgtcctgctccatcctgccctgatgtgaatcacccctttctctagtgaatccatgctgtgtatgctctctgcctgtgcatcacttagtagccatcatgcttattgtatcgactgtcacagcatcgtagtgcttgtgttcaagcaacccttattttactgaataatggcctcaaagtgcaagaacagtga

SEQ ID NO: 1058 - DNA, 661 bp, Homo sapiens
  LOC392223
  misc_feature [331]..[331]: Chromosome 8, SNP identification no. = rs433881
  misc_feature [331]..[331]: allele = g, in linkage disequilibrium with rs444772, respectively
  misc_feature [331]..[331]: n is a, t, c or g
caactactgtctttgtttttagtggcccccaggagtttagggtgtgccaagtcctgtcagtgccccagagataggtaagatagaagtcagtctcttgagaagcagctggaaaagatgagttgctagatgtgtgatcaagttcgttttttcctcaggcagaaactcagagctggagtttatctctcactcactctgcattaagctggggagaggatctgtggcaaatgcctgcactcctattcagaccacacagttgcattgctgtttgttgctcccaagagcctagcaaatgcccagtttcatcagttcttagagacaggtgggtcagctngagacttgttctatctctggaatgaaccagaggaaagagctgtatgaagtgtgcagacactcagtagactactgattgcttgttctgtcaccgcctggatgcaagataattaaaaatgtaacccatggaaatcgttgggaaacttgacattaggtgtacactcaaacccctttcaaagaaaaactgggtgctgggggtttttgcctgctttctctgcatgaagccaggagaaagctgctggaagtgctccttatgtgtttaaagcatctcttcattctctgtggtccctggggtacttgagaatgcctatccccatcagctcctacagct

SEQ ID NO: 1059 - DNA, 661 bp, Homo sapiens
  LOC392223
  misc_feature [331]..[331]: Chromosome 8, SNP identification no. = rs437439
  misc_feature [331]..[331]: allele = a, in linkage disequilibrium with rs444772, respectively
  misc_feature [331]..[331]: n is a, t, c or g
agctggggaagaaggcatgtctgttcaggttcacaaaggacttctaattacttgacttatcaccaaccagatgctggctaagtagaagctcaactctggggcaacatctaagaaagtgcaagtccaaccttttgtagtgagaaaatgggatttgggtatttttgcctgcttgctctgtgctaagccttatgtgggatagctgctggaagtgttcttgtacccagttaaaattgcctctttgttctctgtggtaccagggacttctcaaatgctgagcccccacatttccagaggtaggtaatttaggagccagttgtttaggtgggagctntgaaagttgggatgctcagtgtgtggagaaactcttttcagggagaagctggagacttggttttattgctggagttagctagggtgagaagacatgggaagtacccacatgcctattgaggctctgggaactttactaatttcctgccctctaggcttccagatgtactctagttaaagccctgaccccgggacagcagctgggattgtgtgcagtcagacctcttccagggagaaactggaagttagataattttccttgcttactctgcactaagtctaggggtatggctgcctgtttaaaaagacctcctagttctctgtggtccca

SEQ ID NO: 1060 - DNA, 661 bp, Homo sapiens
  LOC392223
  misc_feature [331]..[331]: Chromosome 8, SNP identification no. = rs450496
  misc_feature [331]..[331]: allele = g, in linkage disequilibrium with rs444772, respectively
  misc_feature [331]..[331]: n is a, t, c or g
gttataccgtctgacctccaaagactgaaagtcaagaaggtacctgcatggtttatttgtttatgtttatgttgttaagtaaaactctctttaagtctgtgaacaacgttgtgtgtgtgtgaccctttgactcttttataggtgtggctttgtccatctttttcgactctattcgaggacggcgtttggtgtagggtctttatcgtgacgtgtcagtcctcgaagaggtcgaagtttttccttcacaaacaaaaagtagacctcgggtgttagagaaagaacagaataacagagagacgacatgacttcttagagacgacgttttttgtcngacgtcccgaccggagacaaaaaggtccgaaggtttgatagacggaaaagacagtaccgaggttcaatcccctctgtatttggtcaaagagtccgtcggaagtttactctgtcttaagacctgtatcctaggtgagaaggtaaagacaggaaatcaataggacaacacgacacgttaagacgtcagaaggataaacattccttctggggtgacttcgggtcgagatggtttgttttcgtgttcaaggagaggaagttttactaccgagggcacacgaggagaagggtccgtacccctacatgtttttatctttttactttcatttttttt

SEQ ID NO: 1061 - DNA, 661 bp, Homo sapiens
  LOC392223
  misc_feature [331]..[331]: Chromosome 8, SNP identification no. = rs446153
  misc_feature [331]..[331]: allele = c, in linkage disequilibrium with rs444772, respectively
  misc_feature [331]..[331]: n is a, t, c or g
ttttttatgacaagtacggaccatgtttaattacctattgtaacaatagggaaataggtggtttgtcttgtcaatcttttcgtcctgaaagatacgttattttctattaatgctcaatactataaatattattagttatatctcttgagattccttttctcttctttgcgtattacttttatacgactgtatgagcaattcttgatcaacccaggagttcctttcaactctatttatattatactattttacagatattaaatgagtcattttctttttcaatttataatgtacgtataattgtaatctttattattttattacataaacngaagatgtaagttgttattttgaccgacatatattaataggtgtaaattgttatatgtatgtctaaatttgtagctgtttcttccctctctacagttcttctaccgtctaatccttcgaggtccgaggttaaatgtgtgcctctgtgattcaattgttattacattcttgatcttatgagaaaaaaacttttgaaatctttggtgaattctctacgtcgtggttccggttacgtattggttctttcctgaagtaggtttttcccgtcttttcaagttcggtagaatgtacgggtacgggatggggatggaccgtatcacgtcacgttgtc

SEQ ID NO: 1062 - DNA, 661 bp, Homo sapiens
  LOC392223
  misc_feature [331]..[331]: Chromosome 8, SNP identification no. = rs453186
  misc_feature [331]..[331]: allele = c, in linkage disequilibrium with rs444772, respectively
  misc_feature [331]..[331]: n is a, t, c or g
ggagacggagggcccgagtttactaggaggatgaagtcggaggactcatagaccataatgtccgtacacggtggtacggtcctattaaaaacacaaaaaacatctctcctccaaaccgatacaacgggtccgaccagagtttgaggacccaagttcgttaggcgggcggagttggaaggtttcacgaccctaatgtccgcacccggtgccgtgggtcggtcatttttaactaacatttttaattaaatgttaattttcctctgtatcaacacgaggttaccaaatatataagtcttatgtctgtttttcacttttagtgtcttatgaaggntatttcagtttctattgcgatatccaaagttaggttctttttatgtactacatcgtataggtaattttttaccattcttttttattggaaacatatcacataatacaaagttttataaaagtatacgtataaaataggagtttatagcgattcactttttttttaggaaagatgtctattctatcaactgcgtgtctaggtcctaatctcgagtcgaggagactgtgtattattctgataaaagaaaacttagagaaacagagatgcattcacgtgacaattcttatatttattcctctttgttttggtaatcgtaagtaattatttttt

SEQ ID NO: 1063 - DNA, 661 bp, Homo sapiens
  LOC392223
  misc_feature [331]..[331]: Chromosome 8, SNP identification no. = rs371043
  misc_feature [331]..[331]: allele = g, in linkage disequilibrium with rs444772, respectively
  misc_feature [331]..[331]: n is a, t, c or g
ctgtctccgagtgagacagtgggtccgatctcatgtcatcacgttagtgtcaagtggtatcggaacttgaggacttgagttcgttagaaggtcggagtcggagagttcatcgaccctgaggtccacacatggtggtacgagtcgattaaaaatttataaaaacatctctaccccagaacatacaacgggtccggccagaacttgaggaccggagttcgttaggagtgtggagtcggagcgttgtacgaccttaatatccgtattcggtgacaagagtcggtctattttgaaaaattgcgtcgtatattctgcgaagtcgaatgagaagtcnaagtagggagtagtgtatgagggcaataactcaccacggtttgagaagtgtcaagggatctagtcaccaagggtttgaatcgtacgtagacgtagtggtcctccctaatgtttttgtgtctgatgactcaaggtgtcaaagattaagtcatctgagtcgtgtccgtcggatgtcactagtttacggggtcaaacgggtcctgtctcccaaaagggtcctacgtcctaaaagtcacgattttggtcctgtctgtatccatttggtcttatcggtgtccgtttggtcataccgatcagtaggatctattctggggttcgtaacttagaaatt

SEQ ID NO: 1064 - DNA, 661 bp, Homo sapiens
  LOC392223
  misc_feature [331]..[331]: Chromosome 8, SNP identification no. = rs394020
  misc_feature [331]..[331]: allele = g, in linkage disequilibrium with rs444772, respectively
  misc_feature [331]..[331]: n is a, t, c or g
taatactgctttagctgtgtcccagagttctggtgtgttgtctctttgttctcattagtttcaaagaatttcttgatttctgccttaatttcgttatttacccaggattcattcaggagcaggtcgttcaatttccatgtagttgtgtggttttgaatgaatttcttaattttgagttctaatttgactgcactgtgatctgagagactgttatgatttcagttcttttgcatttactgaggagtggaaactctaatcttatatagggctgtccatccttccttctagagaatgagccagagaatgaatttgaacacagcacaaattcatnaactttcttaaaacatgatgagattttttttttcttttagctcatcagctatccttagtgttagtgtatttcatgtgtggcccaagacaattcttccaatgtggcctggggaagccaaaagactggacacccctcttctcagttttatgactaattgaatgcagctgatgcaacacttgaacttctaaggtctgcatcttctatccttacttctcgaattaatccttcttggaacccagccctcaggtggaaaggaaaccaggcagccatgcagagaggtccttcaggaaagaactggccctgacagccccagctgaatctccaaccagc

SEQ ID NO: 1065 - DNA, 661 bp, Homo sapiens
  LOC392223
  misc_feature [331]..[331]: Chromosome 8, SNP identification no. = rs395862
  misc_feature [331]..[331]: allele = g, in linkage disequilibrium with rs444772, respectively
  misc_feature [331]..[331]: n is a, t, c or g
tccttcttggaacccagccctcaggtggaaaggaaaccaggcagccatgcagagaggtccttcaggaaagaactggccctgacagccccagctgaatctccaaccagcagccatcaccaactgctagcatgtgagcctctctgtagatcaaactaactggtagatgatgcaaatagaaaaactttttacccttcagtgtttctagcatcttaatatgctagtcttgccatatacaaagcagaatgagaagttctaaaaaaggcaggtggaggataatatgagtaattttcctcaatgtaactgacatttttgcaacaggaggtcttttatntgtgataattacttgcaggattatttcctgatgttatgctcagtgtcccataaattcacactaacgaatcagttttcacatgcctggaaagtgttttgatgaacaatgctgacctgtagacatcttttcaagaaaatatttcaagactatctccctgagacattttgacttacaattttcactccagaaaaagtttttttttttttgccaccatgaaccaatatttctatttagttattcagctgcttgtgaatttagttttttccatacttagagagttagagtacccatttctctgagttctgctgaaccacttctaggcaatactat

SEQ ID NO: 1066 - DNA, 661 bp, Homo sapiens
  LOC389660
  misc_feature [331]..[331]: Chromosome 8, SNP identification no. = rs858396
  misc_feature [331]..[331]: allele = t, in linkage disequilibrium with rs444772, respectively
  misc_feature [331]..[331]: n is a, t, c or g
gagggagatggggtgagacctaaaacgctgtcctgaacaatagtcatgtctcaatgtagcataaccttctcaatttgtttcatttttgaaagcaaaatttaggaatgagataaaatttctatcgatttcagtttttagtcccaaatactcttaaattaggaggacacaaatgagaaaatgaaaaaaaatgataagatacatattaggatcttattaaattatcctgccaatgaagttatttttccaacattcttccatggattctgagaaatcaagagaaggaagtcattggagcaagtcattggaattaagtctggggaataaaacctantgaatttcaaaatcatgagattttataaatagtacaaagtttccataaaatgaagtagacacctgtatatgtatataatgtgattacattaaattttttttttctgttactaatttagagggtttttttgtttttccttttaggttagtggtgaagccaccactgagctgcgggtgctttatcagcctaaccgctgtgcacttcttgagtcggcactggttcctggtcacacagttgtttttgatcgtcatggcaaaatagctgatgcatcatcagcaggctatgcaaatctttcaaaagaatttgtgatttttgtcaaggtaaaatgga

SEQ ID NO: 1067 - DNA, 661 bp, Homo sapiens
  LOC389660
  misc_feature [331]..[331]: Chromosome 8, SNP identification no. = rs893361
  misc_feature [331]..[331]: allele = a, in linkage disequilibrium with rs444772, respectively
  misc_feature [331]..[331]: n is a, t, c or g
atctcggctcactgcaagctccgcctcctgggttcatgccattctcctgcctcaatctccagagtagggactacaggtgcctgccaccatgcccagctaaatttttgtgtttgtatttttagtagagacggtgtttcaccgtgttagccaggatggtctcgatcttctgacctcgtgatccacctgcctcaacctcccaaagtgctgggattacaggcgtgagccactgagcccagctgaatggtgatttcttggttcttcacttccagcctgtatgcctctctctgactcttccattttttttttttttctcagtgtgctggttatcttnttcttcccagtgagtaaacttcctctgtaagtttttagcagaatctttttgtcctacacttaatattcatgctttttcttcctatttgtgctatgggtgactcagctctatctgatggggctgagggactggaagaagtccttggcattcaattgaaagaatctggtgatcacaggaagttggatggagttgtacagattaaaacacagaagtattatcctgccacaaagaaactattggcatgctcattcttcagatgctgaagctgagtgtgagcctggttaagtatctcacccagagtccccaggtagccttagagctgaggctttg

SEQ ID NO: 1068 - DNA, 661 bp, Homo sapiens
  LOC389660
  misc_feature [331]..[331]: Chromosome 8, SNP identification no. = rs6473950
  misc_feature [331]..[331]: allele = c, in linkage disequilibrium with rs444772, respectively
  misc_feature [331]..[331]: n is a, t, c or g
tgctttcatacttttggtttgtttgctgcattatttcttcctgtggccattgcaggaagactattaaattatttttacagcatatattatgttataccacatggactgcttgtaagctgttatcttgcttttttatgccttaagttttatattataaagaatacatatatttttaaatgtgtttctttgtcttaaatttaatgttcacccagaacaatgagttgaaaagaagatagtattaaattataacatcaattggactatcacctacaaaatattttatgaatatattttatgaaaaacagtaaattctcactaaagtctaagcaangaaaaaaataatttctatttctctggtatagaaactgaagcttaaaaaaaagtgctctcggtcccagaggcttaaattcctagtttctatattggtccatttgataatttttgttgctcttaaatgtattaacttttatctgacgggaaagtataatatatgatatctgacaaattccgtgtatcagaatctagtcatctttggataagatgaaataggggaccatctctgggggaccatttttttaaaacccgtcttgggagacagataaattataatgttacctttaaaaaagtgatttttaaaaattagttattgggtatgctagct

SEQ ID NO: 1069 - DNA, 661 bp, Homo sapiens
  LOC389660
  misc_feature [331]..[331]: Chromosome 8, SNP identification no. = rs1437785
  misc_feature [331]..[331]: allele = t, in linkage disequilibrium with rs444772, respectively
  misc_feature [331]..[331]: n is a, t, c or g
ttaagacacacaaattgttctagggtccgttacgggtaggacgaccggacctcaggtgttctgagatgtgaggacccccgaaggtacacatctgggttagaggtggtgactccattattagatttcgataagtgtgaagtgtcatttactgtctccggtcatcttttgtataggactcggtaaatggtcgtctccctcaggaaccacggacattagacagtagacatctcgtgaagggtagatggtccacgtcgcgtgccgtgtgtggaagggtccgtaagaaatttgatgtgtcgttccgaaaattcactcataataatgggtggaacangattcatcctatgactcctaatcattcctattagtcagataaattgcagtgtcttgatcactctcccactaaacttggaccagagactgaggttccgaagacaagaattggtcaaatactcaaaatggcatacagttatcctaaggaaaaaattaaatatgtgtaaaagagaaaaacagtagtgttatggaattttaaatctttcttttctagaataacggacataagatatgtatttctatcacgaccggacctctttaattcaccgtataagttccagtgtattgattgtacacccttcgttcctgaggttagatcgagtaggctaaa

SEQ ID NO: 1070 - DNA, 661 bp, Homo sapiens
  LOC389660
  misc_feature [331]..[331]: Chromosome 8, SNP identification no. = rs2043774
  misc_feature [331]..[331]: allele = c, in linkage disequilibrium with rs444772, respectively
  misc_feature [331]..[331]: n is a, t, c or g
gtggatccgagggatccctcgagggaacgggagaaggggaaaactcatatccggacgcgacaccgaagacctgtctaatgacgacctcccttgaaggaggtgtacgttagaacagtgttgtagtggattatattatacacacgatgacggagacgtggtaccagtatagaaaaaggatttagtttggggtttacggagtttggggatgtcattacgtgttataaggaaagtatcttacaattatctaaaatggactttttatactggggtaccacttaaatcaaaacctttacgacaatttgtctaaagggatggtgtcccgtagggtctnggaaatgatataaataaacgtaacactgaaaggttctctccttactttttgagtcacaaaggttttgagtacaccctttgagtcacaaaaggtgtgacctttgtaaataacccctcgtagaaccctttcgtcttcgtaccgaccgaaaaatgtagtacccttcgccggagtcccgactccacttacccgtaatcacccctttcattgaagaaacttaacgagtgcatttatgaccacagatttttggtaagaggtgatttaatttgatcccgaggaactctttatccattaaggtcccgatcccttttctttcatgatctattcggactt

SEQ ID NO: 1071 - DNA, 661 bp, Homo sapiens
  LOC389660
  misc_feature [331]..[331]: Chromosome 8, SNP identification no. = rs7000259
  misc_feature [331]..[331]: allele = t, in linkage disequilibrium with rs444772, respectively
  misc_feature [331]..[331]: n is a, t, c or g
aagccgttgtttctaaacaagtgtttgttgaaatcattcctagtgtcccagattaaaatgggtgaaaacctagtttttgacatagcattttgagcagggaacacctgcccatttcatgatactctggtactttggggcttttgatctagtggtgggtcatgtgatgtcattcagagtcttaaacttttattccttgatcatactttagaggcctttgtgaaggtctgacttgctatttcagccatattaatgcacactaaccaactgtgctgtctagcgtccaaaacactgttgtagaatattaatccaggtcatcatactgatttcaggnaatgggtagcttctacccaaaacaagatggctataactgaacatagacagatagtaattaactttgaatattaaaaaaagaaagataagcatacatgttagcaaatgctgttaaataaaactaataattgtttttaaatcttaggttttcttttttttattctctggaattgactttggctctttcaaattgaggtaataaactttagagttgaagtcaaaagacttgaaagatgtttaatttctaaaaagttaaaaaatcactttttctctaggtttttcttactataaaatagggctcaacggtacttggtatctcacaagttgtgaa

SEQ ID NO: 1072 - DNA, 661 bp, Homo sapiens
  LOC389660
  misc_feature [331]..[331]: Chromosome 8, SNP identification no. = rs4737673
  misc_feature [331]..[331]: allele = c, in linkage disequilibrium with rs444772, respectively
  misc_feature [331]..[331]: n is a, t, c or g
cttcagggttctagaaagaaccacataaaggaaatagcaagttctgaaatgcggtaagaaaaatagtttgtttttgaagattttctagttcagtgaacagcaggaagcaccagcttcttttcacaaaatctccaggcaaatgtttaatctcaaaagactccagtagtttatagaaacattctcaaagttgtgccagcttatttgaaccaaagataaattcatgtatttgatagtccctcagtcagttgtaaataccatagttggtcccccttgtacagtccttgataacaaatagggtattatcacaaggcacaggatgagaaataagganatttagagtcaagctttgactttgtgtctgatttgcaagaacacttaaaatgttccgtatgaacacatttaaaccttattatattttcatatttctggctatacaaagaaaatactaatgactgacatgagtgccccatccaccatccccagtatcagatcttatagagtactataaatacgttgtgtccaacaaacgtgttggtgactatttgcctttattttttcagaaaaagctttgtgtatatggaatctgtaatgagagtagaagtatttttttttgttttatagaacaaaggtttatgatatttcagggtaggatttctaaaag

SEQ ID NO: 1073 - DNA, 661 bp, Homo sapiens
  LOC389660
  misc_feature [331]..[331]: Chromosome 8, SNP identification no. = rs1509678
  misc_feature [331]..[331]: allele = t, in linkage disequilibrium with rs444772, respectively
  misc_feature [331]..[331]: n is a, t, c or g
accacgcaaaatgtctggtgactaaccacgcaaaatgactaaccactcaacacgtcccgtgactaaccacgtaaaatgttaggagaacaatccatgtctcgtgactaaccacgcaaaaatatctcgtgattaaccacgtaaaatgttaggggaacgatcgatgtctcgtgattaaccacgtaaaatgttaggggaacgatcgatgtctcgtgactaaccacgcaaaatgttaggatcgatgtctcacgactaatcccgtaaaatgttaggagaacattctgtcttttcaagaggttcaggggtgaactggatccttcaggtcgaccgaagnggagagtcactatgaatccttataacattttctcgaactaaagtcttgtagatttaaaaggttcaattgtcattctcccgccaaaaacacggatcttcattctagtgaagaaaggtctaggtgtacgatcgatacattatacccttaacggatcaagagttttggagttacaagagttaatcctaatactattatagacggaaagacaccatatttgtaattttcactagtccatatgggactcacgagttgtgtacaaataacaaaaatcattattatcatagttttaattagagtctctaacctctagtcttaagaatttttaataaa

SEQ ID NO: 1074 - DNA, 661 bp, Homo sapiens
  LOC389660
  misc_feature [331]..[331]: Chromosome 8, SNP identification no. = rs2375220
  misc_feature [331]..[331]: allele = g, in linkage disequilibrium with rs444772, respectively
  misc_feature [331]..[331]: n is a, t, c or g
gacaatcaaagaaatatttagttgatattacgaataaggcacaagtaaaattcataaaaagttagttatcaatttgagttattcttacatgatattttttacacattccgaccattagaactttgtctttacctaataaagtctactaattttctacttttcaccgttgttgtaaatggtaaacgaaggagaacataaaatccaactactaaataaacgtaaagacgtttttattttcacttcacgtcaattattgtctagacagactactgtaacattcacccttttcttctttgcactcaaattgagaaattgtctccgtttaggaatncaactaaaaattgaagttaatcccgtgtgttgtaaagattctgtgtcgaaatgtatacaaaaataaagtgacactccttatgatatttaggttattattttctatttatagtttcccctacaagactccttttgaccccttatcacaaggtactacaggtctacattgttttagtagaacatgaaagaagatgactaccaaagtcattaggagtggaacttctatttcaagttaaagacttacttaatacgggactctgtactttccttcggtagactcctttttctctctctctctttctttctctctcctcttttatctctcttttaa

SEQ ID NO: 1075 - DNA, 661 bp, Homo sapiens
  misc_feature [331]..[331]: Chromosome 8, SNP identification no. = rs1553764
  misc_feature [331]..[331]: allele = c, in linkage disequilibrium with rs444772, respectively
  misc_feature [331]..[331]: n is a, t, c or g
gtgcttggctgtgtggtgtggactcagggtgagaggggttcattgctgtgggttgatgatgtagtttcccaaagaagtgcacaaaataataaaatgaagacttattttgtctttctaactaaaccaatcataaaacaactcatagatctttttaagttgtttcctgtcatgctctgcttgtctcagcctttctgtgctctcagtatcactgcagcaggaagctcaatgatcccttctgcttgcatgatgcattgtctttctctatttcaaacgtgtcttttcttcatcctccctccccaagcccaattccttttgccaagacctatttatncagtacagcattttcttccttacttgttggtttgttccaactttcagggaactccagcaatttttcatgagaaagaaagttcttttttgccttgtttttatatcttctacatccttagcactatctgctaggatcaccaaactgtgttactagtgtagcttgataggactcttctctagtacagatgatgccttaacatcaggttatcaggatgcctgtcatccattcccatccccaaatttgacagttatttgcctaaataaactcctaagtatttcagctaaacacttagtgctaaatgcctccaactccattgttttgcccaaaata

SEQ ID NO: 1076 - DNA, 661 bp, Homo sapiens
  misc_feature [331]..[331]: Chromosome 8, SNP identification no. = rs1498181
  misc_feature [331]..[331]: allele = t, in linkage disequilibrium with rs444772, respectively
  misc_feature [331]..[331]: n is a, t, c or g
tttgtttatctaggaaagtcttaatttgcatatgcaagtcttggttgacagtttttttctttcagtactttgaatatgtcatcccacttctttatggcctttatgatttctgatgagaagtcagaagttaaccttattaaagatcctgtacatatgataagttgtttatcttctgctgctttcaagattctctgcttgtttttggctttcaaaaattttactgtgttgtgtttaggtgtagatcaccttactgttggttttaatagttactgtggttgcaaggttgccagttttcaagactattgtggagttggggagggtggtagagagnagatcaaagtacttataaggtacccttatgtttctaccaatgttcgtcgttttcattgaatacatgctcctcaatttgttataatcctttgattaattttcagagttctagataattccatttcaataatttttttattgcttttgtggagcactggatttatggagagtctccgtctgccatttcagaagtcctgctctgctcttattatcttgatcatattttgttatttttaattcaagtttctatttctccatgaaatcttccatgatttctataacttgctgaagataaataagaactggcccaatataaatttggatttgaggc

SEQ ID NO: 1077 - DNA, 661 bp, Homo sapiens
  LOC401460
  misc_feature [331]..[331]: Chromosome 8, SNP identification no. = rs1498182
  misc_feature [331]..[331]: allele = g, in linkage disequilibrium with rs444772, respectively
  misc_feature [331]..[331]: n is a, t, c or g
ctatgacaccagaagcacaggcaacacaagcaaaaatacacaaacgggctgtattaaactaaaacgtttctgcacagaaatgaaaataatcagcaaaataaaaaggcaatgagttgaaatgaaatgggaatgggagaaaatatttgcaaaccaaatatctgataagggattaatatcccaaatatatcaggaactcattcagcttaatagtagaaaaacccaaataatataatttaaaaatgggaaaagacctgaatagacattttcccaaagaagacatagaaatggccaacatgtacacaaaaaggtgctcaacataactaatcatcanggaaatgcaaattgaaactgcaatgagataccacatctaacctgttagtatggctatcatcaaaaaaacaagagatagtaagttttggtgagaatgtggagaaaagggaacccttgtatattgcttgtgggaatgtatcggtacagacattatggaaaacagtaaggagaggcctataaaattaaaaatagagctaccatatgatctgcttctgtgtatatatctgaaggaaacaaaatcagtatcttgaagagatatctgcacccatgtggtcattgcagtgtcattcataatagccaagacataggaacaccttatctctccatcaat

SEQ ID NO: 1078 - DNA, 661 bp, Homo sapiens
  LOC401460
  misc_feature [331]..[331]: Chromosome 8, SNP identification no. = rs1039842
  misc_feature [331]..[331]: allele = a, in linkage disequilibrium with rs444772, respectively
  misc_feature [331]..[331]: n is a, t, c or g
tcatatgattccaaggtctgaaaagctgcccatattattctgactttcatcagcatctgaagtcactgacaaaggagagagaatcaacaacactggcagtgcctgaattttgagagaaatctgaacaaaacatttgatactgagattgctttagatcatcctggacagagagtttttataaacatccctgattattctctgtcaagaccatttaactgttttctgaatatcgtttcaataaatatgcttatttgctagttatatagtatataattagttatgcctggctatctatttatttctatctctaagctatctttcagatgaaatntgtatattatggcagaattattaacattcttcaccaagtttgaatattggtctctagcatcacagtaaataaaatttgtgctctcaacttgtccacagaaatagataccacaataaaataaaataatacaaaataaacagtggcatatttcacacccatgacttgaatcctattattctaaatggcttacctgttgtatattataccctgtgaatttgtgccatgttaattggaccttgttccaaaaagtgactgagtttatacagctggaaaatgcaagcaacctggttggactctgggtgttttgttggtatattagttataacatcc

SEQ ID NO: 1079 - DNA, 661 bp, Homo sapiens
  LOC401460
  misc_feature [331]..[331]: Chromosome 8, SNP identification no. = rs9298510
  misc_feature [331]..[331]: allele = c, in linkage disequilibrium with rs444772, respectively
  misc_feature [331]..[331]: n is a, t, c or g
ctttgcattccctgacattctccacagatttgccatcagcctgagctttgaatagttgtgatttaatactgaggttgctagcatgtggggtacagggaatgggagttagaatcctgatcttcttaagaactcttagcctattttatgggattggaatacccagctagttgttacagagcatgactctagaagatgtgagcaaagctccccttcctttcatttttcacttgaccattattttaccatttctttgttaaaaaatgtttcttctgcttccaattgttaagtcagaaataaaaagaaaaatgttactcctgcacgggtataatcncataaaatttggaagggactgatgaacagacattggtgtatagttgcttacctctttgttcatcttttctctctggaaactctgactactatgttactagagtagcccttgatggccacaccccgttctacctagatcagcttcacagagcccactgaggtttgttaagttccttatgtttaacaacattatctgtcctatagcataaacaattagtacatataattttataatgctaatgaagaagataagctaccaatgaagctaaaagctctagttctaccaagtatttgaatagttgtagtatttatgcaaataatttcacttggc

SEQ ID NO: 1080 - DNA, 661 bp, Homo sapiens
  LOC401460
  misc_feature [331]..[331]: Chromosome 8, SNP identification no. = rs1498189
  misc_feature [331]..[331]: allele = a, in linkage disequilibrium with rs444772, respectively
  misc_feature [331]..[331]: n is a, t, c or g
aaactttatacattaaacttgagtgtgaattgaaatgggtaaagtgtctataaacttcaggatacagacaggccacggtacatgactgcttcttcgtatgtatactgtgctgaagaagggagggtctcgtatgtcgagtctttaccaacgtctagaattttacaattaatgattacactaatcatgacgttctcccccgacacgtccatatcttttacaactgaattttatcaaatccaacctctgactaaactcgttattattttatcagatcctaccgtcttttacaatgtaaaacaataattttaatgtttatcacaactattaaacnatttccacccaaacccctattagtaatgtccttcgtcggaccgtcctcccgggatattattcctacgaccacttcacgtctgtacccttctgtccggaccgaactcaaccgtcgtcattgttaagattcctttcgacgtttcgtgtggtgtcgttttgttttacctatcttggagtatgatacacgaacaagttctagtccccgaagagggaagagatttgaccgaaataaaaccaacaaaattttattcgtttctactcctacgaagtcccatcgttttctggatctttgttggttgttcccaaataagacgatagagaattaagagat

SEQ ID NO: 1081 - DNA, 661 bp, Homo sapiens
  misc_feature [331]..[331]: Chromosome 8, SNP identification no. = rs2853129
  misc_feature [331]..[331]: allele = a, g
  misc_feature [331]..[331]: n is a, t, c or g
ttccagggggcctgccaggtctccttcctggctgaggggcaccctgaccactgtgcccaggattccagtccttcagaactgattttcttgggctccacctcatccccatggcagttgcagcacctgcgatcagcctcctctgtgctccccgacctcctctgacgcctcctgctgggctttctcagaacttgcctggaatgtccatttcaccatcttggtcttcccaaccctgtgtgtcttccctatcggttctcatgctcagtcctagccttgactttggcatcttgctcctggctctggcttttgcatgtgaccttcaatatggatgggntagtgactcatggaaaatgctcacatcaaagctgttatcctaaccccgttcctctgcacatcagtgaacataacctccagcttcctcccgtgggacccggcaacacctcctcctgttaagtcgccagggataaacttccggttcaggtcctcattattttcttcattccttagcaccctctcctcaacagtggccttctgttattactgtgatctcaccaatctattttaaaacctcctgttgcctttacaatctcgctcatgctgcatctttcactacaaaccaactttccttccagagcaacggacactgagctagatgttcatattg

SEQ ID NO: 1082 - DNA, 661 bp, Homo sapiens
  misc_feature [331]..[331]: Chromosome 8, SNP identification no. = rs16902149
  misc_feature [331]..[331]: allele = c, g
  misc_feature [331]..[331]: n is a, t, c or g
aactccatgtgtggaagcttgatctcctttgaaaagagctcagcttaaaggatgatatcatggggactgtcaacaggaatcagagatgcatatccaagggcagaatctaatttcaattccaggacgtttcatgaaacagaatgcaaagcaacaattatctgctaaatggaaaattaaaggcataaataaagtcaaagctcaaaccagtgaggcaaaaatcacacgggctccaatttccttttgctgcttgtagctgcaagtttgaaaggaaggacacatggggatagtaaaaatatgagagcaatggaccacgtttaatcgatagtgaagnctctgatcccacaaatgctccccttcccactattagcccttccccacctactgccaaaacccagcaagctgaatggagcaagacatctgagaaagaggcccctgttctctccataggaacttcactttcctataaatgtgctccagcactgagtaagttctggtaaaaaagagctttatttccccagactccttgttcctccacttctgccaaaatacatttcttaagtattccaacctgaaacacacacatgcacacacatacacacacatatgctgccaatttcttggtattttgtcaatactgactttgccccttttctaaatcttc

SEQ ID NO: 1083 - DNA, 661 bp, Homo sapiens
  misc_feature [331]..[331]: Chromosome 8, SNP identification no. = rs3847136
  misc_feature [331]..[331]: allele = a, a, a, a, in linkage disequilibrium with rs3847137, rs10505474, rs10956369, rs7014346, respectively
  misc_feature [331]..[331]: n is a, t, c or g
atgcatatccaagggcagaatctaatttcaattccaggacgtttcatgaaacagaatgcaaagcaacaattatctgctaaatggaaaattaaaggcataaataaagtcaaagctcaaaccagtgaggcaaaaatcacacgggctccaatttccttttgctgcttgtagctgcaagtttgaaaggaaggacacatggggatagtaaaaatatgagagcaatggaccacgtttaatcgatagtgaaggctctgatcccacaaatgctccccttcccactattagcccttccccacctactgccaaaacccagcaagctgaatggagcaagacntctgagaaagaggcccctgttctctccataggaacttcactttcctataaatgtgctccagcactgagtaagttctggtaaaaaagagctttatttccccagactccttgttcctccacttctgccaaaatacatttcttaagtattccaacctgaaacacacacatgcacacacatacacacacatatgctgccaatttcttggtattttgtcaatactgactttgccccttttctaaatcttcatctccaattaaggcttcctgtttgatagacaagtggtgacacatgacacagaataagcccagtggaagactttgtttcccacgg

SEQ ID NO: 1084 - DNA, 661 bp, Homo sapiens
  misc_feature [331]..[331]: Chromosome 8, SNP identification no. = rs10505477
  misc_feature [331]..[331]: allele = a, a, a, a, in linkage disequilibrium with rs3847137, rs10505474, rs10956368, rs10956369, respectively
  misc_feature [331]..[331]: n is a, t, c or g
tctaaatacctaatcttttcagtaacaacgtcgacaaaactctcaccttaacttcaccacttgaaacgtcaccaggttcattttctccgtcacccctagttctcctcccttttctaacctttgtgtgaacaccccttcttaaatttcctctcgtcccttctgtctcccactccctccccaccttcagtgttcgtaaccaacatttagtaccgggtttcgtaaactgtgaactgggtcacagaatgtatacctgggcaccctttgtttcagaaggtgacccgaataagacacagtacacagtggtgaacagatagtttgtccttcggaattnacctctacttctaaatcttttccccgtttcagtcataactgttttatggttctttaaccgtcgtatacacacacatacacacacgtacacacacaaagtccaaccttatgaattctttacataaaaccgtcttcacctccttgttcctcagacccctttatttcgagaaaaaatggtcttgaatgagtcacgacctcgtgtaaatatcctttcacttcaaggatacctctcttgtccccggagaaagagtctacagaacgaggtaagtcgaacgacccaaaaccgtcatccaccccttcccgattatcacccttcccctcgtaaacaccc

SEQ ID NO: 1085 - DNA, 661 bp, Homo sapiens
  misc_feature [331]..[331]: Chromosome 8, SNP identification no. = rs12334317
  misc_feature [331]..[331]: allele = c, in linkage disequilibrium with rs10505473, respectively
  misc_feature [331]..[331]: n is a, t, c or g
caaaacagctgcaacaatgacttttctaatccataaatctgattatatttttcctttgttcagaaaacacaatgggctcccattgcctacaagataaagaccaccctctatggccatgcctaccaggaccttcatcaataatcccccttaacctcctccaccactgatgtcattcatttatcttttcactcattcattcaaaaccatgaagcatccactgtgtgccagccatcattctggacgcacagccaaactaaacttctctttcccaaacacttcctgccctcttacaacactgccttctcacagcgttctctttgccagaaacgcntctattcctcttctatcaaactctcattcacctttccagattcagcctcctcggtgtgtcctctgtgaagctttgcctaagacagacacacgcatgcacacacatgttccaagcaggttctgtcttctgtatccccacccaccatggttttatgaaatgaccatgacttgtatcactttgagaaatcactgcctgcttgtctgtttcctttctaaggcaaagattgtatcaacctcaagggcaggagagcattatatacttttctgtatacttaactcactgattggcacataggaagtgcctgtgaatgtttgctgtgaatgtgaacct

SEQ ID NO: 1086 - DNA, 661 bp, Homo sapiens
  misc_feature [331]..[331]: Chromosome 8, SNP identification no. = rs10505476
  misc_feature [331]..[331]: allele = t, t, t, t, in linkage disequilibrium with rs3847137, rs10505474, rs10956368, rs10956369, respectively
  misc_feature [331]..[331]: n is a, t, c or g
ggagtcttatcgaaccttaccgattcaccaaaaaaacggtccaccacctccgtccaagtgtaagtgtcgtttgtaagtgtccgtgaaggatacacggttagtcactcaattcatatgtcttttcatatattacgagaggacgggaactccaactatgttagaaacggaatctttcctttgtctgttcgtccgtcactaaagagtttcactatgttcagtaccagtaaagtattttggtaccacccacccctatgtcttctgtcttggacgaaccttgtacacacacgtacgcacacagacagaatccgtttcgaagtgtctcctgtgtggntcctccgacttagacctttccacttactctcaaactatcttctccttatcttcgcaaagaccgtttctcttgcgacactcttccgtcacaacattctcccgtccttcacaaaccctttctcttcaaatcaaaccgacacgcaggtcttactaccgaccgtgtgtcacctacgaagtaccaaaacttacttactcacttttctatttacttactgtagtcaccacctcctccaattccccctaataactacttccaggaccatccgtaccggtatctcccaccagaaatagaacatccgttaccctcgggtaacacaaaagacttgtttcc

SEQ ID NO: 1087 - DNA, 661 bp, Homo sapiens
  misc_feature [331]..[331]: Chromosome 8, SNP identification no. = rs11985829
  misc_feature [331]..[331]: allele = t, t, t, in linkage disequilibrium with rs3847137, rs10505474, rs7014346, respectively
  misc_feature [331]..[331]: n is a, t, c or g
caagtttttcataacccttaaactcgtctttccctttcaggctttcctgctatttcttaccttgaacgtccttctctttcacctgttcattcttcatgatggagctcaagtctccttcataaaggcaccaaagaccactcctcaccgatttgtctcaccactggagcctgtgcatgcccagatcccagcatttcccacttgtggtttacagtccgtttctcctagtaagtccagagtgctgtgacttcagggacagtgtctatgcacctagcatagcttttctgaagtccttccctgggctaggcattgcggcagcttctgaggataccangtagctcaagcatagtccctgccctcaagaagcagacaagaaactaacctgaaagtctatggtgatgataaatgtgatatcatatggtccctgccctcaagaagcagacaagaaactaatctcaaggtctatggtgatgataaatgtggcattgttcttggcaactacaaggaaatcagtgaaaaggggaggacagagagaagaaagcccagaaaaaggaaagaaagcaagaaaaagaaggagggaggaaagaaagaaagaagtgaattgaggccatggagttacttcagttgtcaaatgttccactggaatatatttacaactatgaaa

SEQ ID NO: 1088 - DNA, 661 bp, Homo sapiens
  misc_feature [331]..[331]: Chromosome 8, SNP identification no. = rs10808555
  misc_feature [331]..[331]: allele = g, in linkage disequilibrium with rs7014346, respectively
  misc_feature [331]..[331]: n is a, t, c or g
ttctgaagtccttccctgggctaggcattgcggcagcttctgaggataccatgtagctcaagcatagtccctgccctcaagaagcagacaagaaactaacctgaaagtctatggtgatgataaatgtgatatcatatggtccctgccctcaagaagcagacaagaaactaatctcaaggtctatggtgatgataaatgtggcattgttcttggcaactacaaggaaatcagtgaaaaggggaggacagagagaagaaagcccagaaaaaggaaagaaagcaagaaaaagaaggagggaggaaagaaagaaagaagtgaattgaggccatgnagttacttcagttgtcaaatgttccactggaatatatttacaactatgaaaaggaatcactttcactattccagacacatttttgctgattcctttagcacagtgtttcccaaagagtggccaccatgccccaggaggcatttgaccatagtgtgcagaaggatattttaaattgtaataattgcgtacttcaacgtgtgttagtactaagtttctagcctttcaaacctatcttttcatggatattattgctttgtttagagtgagtgtaaacaaattacaagtgagtaaaactgaggggttctgatttcatgtcttgcctagaaaaga

SEQ ID NO: 1089 - DNA, 661 bp, Homo sapiens
  misc_feature [331]..[331]: Chromosome 8, SNP identification no. = rs17467139
  misc_feature [331]..[331]: allele = g, in linkage disequilibrium with rs16902149, respectively
  misc_feature [331]..[331]: n is a, t, c or g
gattaaaatcaccatagcaatcttagaagcagatgttaaagatgacttagttctgtcagcctaggtccctcaatgagcacatggagcagaatcacccaacaacatattcagccatcttcagaactgttaaattgaacaagaaagaaatttctgataagtgtgagcctttatgtatatggaatttatttgttatatcagttagggttacttgaagtaatacaactcttcccagtgatcctcaactagaaaagaatttggagggcatgttagaatctcatgggaaaaggggcagttggaaaaatcttccgaagtataatcactgtcttatgtnctttacaataaacgcagaaatttaaagacatatttgactagatgaaaggatttgtggaggtatggaacacacacattcacccacatgtgtggacatagaaggcagatacaacaaaaattacggttcatcaccaatagtggcagaggatgggtttcgagccacttcctttcaaaccaaccacaacgtcataagtgatcaccatcattctagttcctgtgaagaagagagagctgtggaaaaaatgctttatgccctcaaaagagacagcacaaaatttcagtttaaaaggcttgcctcctatgtgattcactagcaatgaaaccttggaaa

SEQ ID NO: 1090 - DNA, 661 bp, Homo sapiens
  misc_feature [331]..[331]: Chromosome 8, SNP identification no. = rs10808556
  misc_feature [331]..[331]: allele = c, c, c, c, c, c, c, in linkage disequilibrium with rs10505477, rs10505476, rs3847137, rs10505474, rs10956368, rs10956369, rs7014346, respectively
  misc_feature [331]..[331]: n is a, t, c or g
gacaccaagagggaggtatcaacagagactccccaagagctaagaggaaaccaccttggactggaagtcaagagccaaaattctagactctactctgtaattaactacctatttgaatttggaaaaatcaccatcaactttcccagcctcgttctctgcatctgggaaatgaaggcgtcgtccaaatgattacaagcttcttttcctgctcttattgcatgattccacttccacagccctccagcattttttagcagctgcatcgctccatagagcctgcagagggcactagactgggaattagaaaacctgatttcccttccagctccanctctgaccaattgcctgaccctggtcaaattgcttaacctcttcctatctcagctccctatccataaaacagagggacgaataaactctcctcctaccactaagaggtgtagccagagttaataccctcatcgtcctttgagctcagcagatgaaaggcactgagaaaagtacaaagaatttttatgtgctattgactttattttattttatgtgggggagggagccggccccagctggaaagctgctttctctgaatcaaagggcaggaacccagcaagtttctcaggattggggccttagactgggctgtgtatacagacagtgccag

SEQ ID NO: 1091 - DNA, 661 bp, Homo sapiens
  misc_feature [331]..[331]: Chromosome 8, SNP identification no. = rs6983267
  misc_feature [331]..[331]: allele = g, g, g, g, g, in linkage disequilibrium with rs10505477, rs3847137, rs10505474, rs10956368, rs10956369, respectively
  misc_feature [331]..[331]: n is a, t, c or g
catctgggaaatgaaggcgtcgtccaaatgattacaagcttcttttcctgctcttattgcatgattccacttccacagccctccagcattttttagcagctgcatcgctccatagagcctgcagagggcactagactgggaattagaaaacctgatttcccttccagctccacctctgaccaattgcctgaccctggtcaaattgcttaacctcttcctatctcagctccctatccataaaacagagggacgaataaactctcctcctaccactaagaggtgtagccagagttaataccctcatcgtcctttgagctcagcagatgaaagncactgagaaaagtacaaagaatttttatgtgctattgactttattttattttatgtgggggagggagccggccccagctggaaagctgctttctctgaatcaaagggcaggaacccagcaagtttctcaggattggggccttagactgggctgtgtatacagacagtgccagccaaccccacagttcagtttcctttaacctggtgctccaggcaataactgtgcaactctgcaatttaacaatgtgttctttgtcccacaactgttctcgtttctcaactgcccaggtaatatgtttgggcctgtaggaagagtcaaatagttaataag

SEQ ID NO: 1092 - DNA, 661 bp, Homo sapiens
  misc_feature [331]..[331]: Chromosome 8, SNP identification no. = rs3847137
  misc_feature [331]..[331]: allele = c, c, c, c, c, c, in linkage disequilibrium with rs10505477, rs10505476, rs10505474, rs10956368, rs10956369, rs7014346, respectively
  misc_feature [331]..[331]: n is a, t, c or g
attctgaaacacctccgaaaatggtcggttagaagtcttattttgggggttggtctcggtctactctagttggatccgacattacttgattgttgaaggtctcactcttacggagagaacaaccgaggtcatctgtcgtcctttcgttcagtctgtactccttgctctttcggtgactctcttctaaaacgatgaacctggtaaaggaccttataatgacagtttattcattttcggactattgcaaaagtccacgcacacacatatgtcaaaatctctttcagaataatttcttatagtctaagttctgagtatgttctttacggaaggnaaaccgctctgttatgaacgtcggccccccacgaaagtgacaacctccacagacgtccatcacgtggacaggtcacccttacgagacagttctacgtgatcacagaagacccgactacaacgggtgccgagagaagggtctcatcttgtccccttcgacttgtggacgtcctatagaacccttactgtaagtttttcgatgtcgacagggtcgactcggtcctcggaccgttcgtgaacctcgtgtgtaataaatacattcgttagagacagtcgcggtgtagacccctatttcctagtttggggttgtttaaattaattccgagaagtg

SEQ ID NO: 1093 - DNA, 661 bp, Homo sapiens
  misc_feature [331]..[331]: Chromosome 8, SNP identification no. = rs7013278
  misc_feature [331]..[331]: allele = t, t, t, t, t, t, in linkage disequilibrium with rs3847137, rs10505474, rs10956368, rs10956369, rs7014346, rs7842552, respectively
  misc_feature [331]..[331]: n is a, t, c or g
tatacacacacgcacctgaaaacgttatcaggcttttacttatttgacagtaatattccaggaaatggtccaagtagcaaaatcttctctcagtggctttctcgttcctcatgtctgacttgctttcctgctgtctactggagccaacaagagaggcattctcactctggaagttgttagttcattacagcctaggttgatctcatctggctctggttgggggttttattctgaagattggctggtaaaagcctccacaaagtcttagctagaacattcatagccctgtgttgacttccgcctcaactctggcttgaacttagctgacggncctatcagtttgctcaaaggagcttttttgctgcaggcaacagaaaggagtggaaagaacacactcattggaacccaggagatccaggctcgcctctggctctaggacttgctcatcatgtgatatcagatacatgacttcatcgctgagtctcagtttccttatctatgaaccggggatattcataccttcttcacaggacaagagaggcacatacaagttcatatctgtccctctatttcaagtgattctcccacatcagaaccagtttggcttccccggcctggtcttctttcaaaggatgcacaaggccatttacaactggcctga

SEQ ID NO: 1094 - DNA, 661 bp, Homo sapiens
  misc_feature [331]..[331]: Chromosome 8, SNP identification no. = rs10505474
  misc_feature [331]..[331]: allele = t, t, t, t, t, t, in linkage disequilibrium with rs10505477, rs10505476, rs3847137, rs10956368, rs10956369, rs7014346, respectively
  misc_feature [331]..[331]: n is a, t, c or g
aaattactggtttagtgaaaatgataaattaagacaagaagacccccactcaatttactattttatagaattcttcctttagaataacttgtttataatagaactgttttgtaaacagtgtttatccactcaaataggaccgaagaatccctttcctccgaaccttatataaattaacacaattctattcgataaaacgaagaaaagggaaagatgacataagggtaaacatttaaaccaggggtttggtacgtcgaaaatgtaagtttcatatgtataaagtgagaggaaaaagggggaaaacgatcaccggatttagtcctaggatagnagagagtaagactagatatctttttgaaaaattaattagagagtcgttggtggtagagggaggagattaagtatgaggtattaagtggttcataagaagatttggtatctttgtgaatacggtgtgtggaaaagactttaaccgtaagatctcaaatattattcagggagataaggagttccggggacagggaccttacgacgacaggatctttcttagggtcgtaaaaaggcagtgatttatctcccacgtagaaataggacgttgtagaataaaatcctatcttcttttgtcggggtgtatcaccccattctttgtcactgtactacg

SEQ ID NO: 1095 - DNA, 661 bp, Homo sapiens
  misc_feature [331]..[331]: Chromosome 8, SNP identification no. = rs10505473
  misc_feature [331]..[331]: allele = t, c
  misc_feature [331]..[331]: n is a, t, c or g
ggatcctcttaggataccttaaatactccttaggactccaaatacgaaaaaaaaaaagatatgtggttgaggtgacgaaaacttgggtcaaaaaaagaagaaaaaaagatcttacaaatttacgatgtgtgtattctgttgacaaagataaaatgattttacgttctattttcgactggtgccttgacaggtttccaagacaaacctctaccgggtggatccagtccctacttcagagatgtttcatgagcaggactcactcaaccttaaattttggaaccggagtccaagcattggaaccacgaggtcctaatctaatccgaaaagactnaccttatgatggtaaagttggtaagattcctcagttgcaagaatatactaattgatgtctttactgaaagttctcgaccacactagtcagattgggagaacaaattactggtttagtgaaaatgataaattaagacaagaagacccccactcaatttactattttatagaattcttcctttagaataacttgtttataatagaactgttttgtaaacagtgtttatccactcaaataggaccgaagaatccctttcctccgaaccttatataaattaacacaattctattcgataaaacgaagaaaagggaaagatgacataagggtaaa

SEQ ID NO: 1096 - DNA, 661 bp, Homo sapiens
  misc_feature [331]..[331]: Chromosome 8, SNP identification no. = rs2060776
  misc_feature [331]..[331]: allele = g, g, g, g, g, g, g, in linkage disequilibrium with rs10505477, rs10505476, rs3847137, rs10505474, rs10956368, rs10956369, rs7014346, respectively
  misc_feature [331]..[331]: n is a, t, c or g
tacctcaaggctagaagggacaaatggagagaatattcactggaacctggagtcagagagccaggtagagaaggaactgagagctttggccaaggttaccctgaagggagggagcagttgattctaatggagaactaacccagaggctcatcaacaggagagtggaaaataaatggtgatatatccatataatgagtagtatacaacaataaagggaataaattactcaggcatgctgcaatatgggtaaatcttaaaaataaattaagccaatgaaaccagacccagatatatactgtataattcaatttccatgaaattcaagaccaancaaactaatctctgttgatagaaattatattagttatctcttgatgtggagactgagttggaaggaccattgaggacacttccgggatggtggaaatgctttatatttttgactcagttgtggttgcatggatatatatatatatatggatatatatatatatggatatatatatatatatggatatatatatatatggatatatatatatatatggatatatatatatatggatatatatatatatatggatatatatatatatatatggatatatatatatatatatatatatacctgcaagagaaaaatcatcaagtggcatctata

SEQ ID NO: 1097 - DNA, 661 bp, Homo sapiens
  misc_feature [331]..[331]: Chromosome 8, SNP identification no. = rs4871788
  misc_feature [331]..[331]: allele = g, g, g, g, g, g, g, in linkage disequilibrium with rs10505477, rs10505476, rs3847137, rs10505474, rs10956368, rs10956369, rs7014346, respectively
  misc_feature [331]..[331]: n is a, t, c or g
tagctccactaggggatatcagagtgattgcttcaagtggagaaagatgggggaaaaaatttgatcagtccagagtgcttctctagaattcaggccactgagggtgagactatatggtgtagcagaatgagcactcgactctgagttaggaaataagggaggctattactagtgatctatatccatcactttccttctgtgagcctttctgtcttgtttctaaagcagtggttctcaagcctggcttcacattagaatcacctgggaagattttcaagctcccagtaccaaaactatgcatcaaaccattatatcacaaactctgagggcnaaaccaaatatccacagtttttaaggcccttcaggagctttcaatttgcaggcatagttgaaaaccttgaaaatatctggagacaggtagctgaaattagtgatccttaaggtagtaatgcatgactttcaagaacgtgaatccttcaggtgcaaatcatctgaggatcttgttacaatgcaggttctgactcagtagttctgacttagtaggtgagagatcctgcagttttataaaagcaaccagtggatagagccgctgctggtcctgggacaacattttgagtaacaggagcaaaaaggtaccttttctctcaaaaatttgaaaagc

SEQ ID NO: 1098 - DNA, 661 bp, Homo sapiens
  misc_feature [331]..[331]: Chromosome 8, SNP identification no. = rs7837328
  misc_feature [331]..[331]: allele = a, a, a, a, a, a, a, in linkage disequilibrium with rs10505477, rs10505476, rs3847137, rs10505474, rs10956368, rs10956369, rs7014346, respectively
  misc_feature [331]..[331]: n is a, t, c or g
ggtggaccatgggaggaaagtgactagagacgcaactgaagaaataattactgtactgagcctcctagaacaggctaaggaccctgagttttaaaacaagggcaatggcaaagatacggccacaccatcatgacagtagagagagggaacacttaatattacccagagctggcagggaagacaaccagaagagcaacatttgagctgattcttaaaaaaaaaaaaaaaaaaaatagagatacacgagaaatccaaattaggatagaattccagaagaagggagtagcatgtgcaaaaaaaaaaaaaaaaaaggaagcaaaaattagcaaanagaaagtactaagtgtatgtcagagagtagggaaagtgagggtcttaagaggccttgagaagtccaacctcaacaactacagacaacaaaagacaaaacccatggtgacataccttttcttattttaatagataacagacattattattaagaacatcttaagaggtagcttccaaacagggtcactgcctacagttatacagggggcacactacccaattccaaggcagcggtttgcatcaatataatgtaaatggcatcccatggagcagtgcaatatgccagccctacccccatttctttcctttttaagttttttcattaaagttc

SEQ ID NO: 1099 - DNA, 661 bp, Homo sapiens
  misc_feature [331]..[331]: Chromosome 8, SNP identification no. = rs7837626
  misc_feature [331]..[331]: allele = a, a, a, a, a, a, a, in linkage disequilibrium with rs10505477, rs10505476, rs3847137, rs10505474, rs10956368, rs10956369, rs7014346, respectively
  misc_feature [331]..[331]: n is a, t, c or g
aaaaaaaaaaaaaaaaaaatagagatacacgagaaatccaaattaggatagaattccagaagaagggagtagcatgtgcaaaaaaaaaaaaaaaaaaggaagcaaaaattagcaaaaagaaagtactaagtgtatgtcagagagtagggaaagtgagggtcttaagaggccttgagaagtccaacctcaacaactacagacaacaaaagacaaaacccatggtgacataccttttcttattttaatagataacagacattattattaagaacatcttaagaggtagcttccaaacagggtcactgcctacagttatacagggggcacactncccaattccaaggcagcggtttgcatcaatataatgtaaatggcatcccatggagcagtgcaatatgccagccctacccccatttctttcctttttaagttttttcattaaagttctttctcttctggacaagaaaaccctatgataatggaatcttcaaactgaaagcatctataaaatgaaccccagattcctggggctttagactttcgttaaccaaataagatgaggaattatgggtgtctgatgtgccaggtactattccaatacttaaaatatatcatcccgtatttctcacagtagaaccatgaagtagagacattactgcat

SEQ ID NO: 1100 - DNA, 661 bp, Homo sapiens
  misc_feature [331]..[331]: Chromosome 8, SNP identification no. = rs7837644
  misc_feature [331]..[331]: allele = a, a, a, a, a, a, a, in linkage disequilibrium with rs10505477, rs10505476, rs3847137, rs10505474, rs10956368, rs10956369, rs7014346, respectively
  misc_feature [331]..[331]: n is a, t, c or g
agaagaagggagtagcatgtgcaaaaaaaaaaaaaaaaaaggaagcaaaaattagcaaaaagaaagtactaagtgtatgtcagagagtagggaaagtgagggtcttaagaggccttgagaagtccaacctcaacaactacagacaacaaaagacaaaacccatggtgacataccttttcttattttaatagataacagacattattattaagaacatcttaagaggtagcttccaaacagggtcactgcctacagttatacagggggcacactacccaattccaaggcagcggtttgcatcaatataatgtaaatggcatcccatggagcngtgcaatatgccagccctacccccatttctttcctttttaagttttttcattaaagttctttctcttctggacaagaaaaccctatgataatggaatcttcaaactgaaagcatctataaaatgaaccccagattcctggggctttagactttcgttaaccaaataagatgaggaattatgggtgtctgatgtgccaggtactattccaatacttaaaatatatcatcccgtatttctcacagtagaaccatgaagtagagacattactgcattttcctatgagaaaatgggactgagatggttaaggtgggatagtataggtagaaact

SEQ ID NO: 1101 - DNA, 661 bp, Homo sapiens
  misc_feature [331]..[331]: Chromosome 8, SNP identification no. = rs10956368
  misc_feature [331]..[331]: allele = t, t, t, t, t, t, in linkage disequilibrium with rs10505477, rs10505476, rs3847137, rs10505474, rs10956369, rs7014346, respectively
  misc_feature [331]..[331]: n is a, t, c or g
cagttatacagggggcacactacccaattccaaggcagcggtttgcatcaatataatgtaaatggcatcccatggagcagtgcaatatgccagccctacccccatttctttcctttttaagttttttcattaaagttctttctcttctggacaagaaaaccctatgataatggaatcttcaaactgaaagcatctataaaatgaaccccagattcctggggctttagactttcgttaaccaaataagatgaggaattatgggtgtctgatgtgccaggtactattccaatacttaaaatatatcatcccgtatttctcacagtagaaccangaagtagagacattactgcattttcctatgagaaaatgggactgagatggttaaggtgggatagtataggtagaaactgttagaacaaacatactcagtcttaactaatttctagatccatgctttgtccgctcctttgttattccttgaagatgttaggggaaattcattagtccattgcaataatgtacaactcctgtggaaataacttacacgcctatgattagaacacataggttcagacatcacaaggctttgatgtgcctgaaattctatcaatttacggggcaatgctagttatctcttggtgatttgtgcctctgtttggca

SEQ ID NO: 1102 - DNA, 661 bp, Homo sapiens
  misc_feature [331]..[331]: Chromosome 8, SNP identification no. = rs10956369
  misc_feature [331]..[331]: allele = t, t, t, t, t, t, in linkage disequilibrium with rs10505477, rs10505476, rs3847137, rs10505474, rs10956368, rs7014346, respectively
  misc_feature [331]..[331]: n is a, t, c or g
taatggaatcttcaaactgaaagcatctataaaatgaaccccagattcctggggctttagactttcgttaaccaaataagatgaggaattatgggtgtctgatgtgccaggtactattccaatacttaaaatatatcatcccgtatttctcacagtagaaccatgaagtagagacattactgcattttcctatgagaaaatgggactgagatggttaaggtgggatagtataggtagaaactgttagaacaaacatactcagtcttaactaatttctagatccatgctttgtccgctcctttgttattccttgaagatgttaggggaaatncattagtccattgcaataatgtacaactcctgtggaaataacttacacgcctatgattagaacacataggttcagacatcacaaggctttgatgtgcctgaaattctatcaatttacggggcaatgctagttatctcttggtgatttgtgcctctgtttggcagtagtctctgccttagatcccttggaaagagagaaactaattccttaaaattttgtttatttgccatcctatcaaaatatgactacctaggggaagaataattaagtggatcattaatggtgtatttaccacatcctgactggaatcataattatttgcttacctgg

SEQ ID NO: 1103 - DNA, 661 bp, Homo sapiens
  misc_feature [331]..[331]: Chromosome 8, SNP identification no. = rs7014346
  misc_feature [331]..[331]: allele = a, a, a, a, a, in linkage disequilibrium with rs3847137, rs10505474, rs10956368, rs10956369, rs7842552, respectively
  misc_feature [331]..[331]: n is a, t, c or g
tcagaccaccacccaaataacccaagagtcttctttgatttttttctctgtctcaacatctccaaacccctctaccccacctagccacttccagtcttatcttttatggtgagaaccagcttcatgtaacagaaactctaaaaaaaatcaatgatttaaataacttgggtatataaatatctctctcatactagaagatcagaggtgggaagtctgagcatgatataatggtcatcaggggtccaagcttcttcattctgcctcaccatctcgcttgcagcttctgcctaatgttgacttacagttcaagatggcttctggagtgctaccnttacatccatgttgtaggctagaaggaaaagggcaatggcctgaagaggaagggagagttcctgttaactcagcttcctttaaacagcctccccaaaagtttcacgctgtatttttgctgattctcattggtcacaacttagtgccatggaagactagtaaatatagtcttttagctggatggcctgctatcttatataaaatgaggttaggttactaagacagaaagggagagcagatcttgggaggcagctagctgtttttgccatcccaagtgttgtgatttctacctgctttcaatttaacctatttgccagtttctctgcatcca

SEQ ID NO: 1104 - DNA, 661 bp, Homo sapiens
  POU5F1P1
  misc_feature [331]..[331]: Chromosome 8, SNP identification no. = rs871135
  misc_feature [331]..[331]: allele = g, g, g, g, g, g, g, in linkage disequilibrium with rs10505477, rs10505476, rs3847137, rs10505474, rs10956368, rs10956369, rs7014346, respectively
  misc_feature [331]..[331]: n is a, t, c or g
actggtcaaacacattttgtgcttcttaaaaaaaggtggtacacacacacacacacacacacaacacccgatataatacaatattttcaaatgacactagaaatattttagtcaggtctaaaggaacagaagttaatgataaaatgataaacaataaataatagctactgtttcatgagaaaattacacacatcttacttgacttaaacctcacaacagaattgagcagaaagttattaccctgagaaaggggacttaaggttggcaggataacaagtgggagaatctagaggtaaagtcatatctatcttattggaaacactcaagaacntcaaataagcatgagaatttgagcaagactgaaggagaacgtttaagttccctttccaactcatatcccaattctggaatctaatttctgtaacaagtaactatattccttactacagaagtaaagatggccccatggagaaactggcagcatggcatgatggaaatggaatagaatcaggaattgttttgtacctgtgtgtgtgtgactttggtgttctgactcagacacatatttgagaggtagagaggggagaagagggttgccacattatgtaacagaaaggagcccactgcttaaacacttaccttgtgccagacattgcactag

SEQ ID NO: 1105 - DNA, 661 bp, Homo sapiens
  misc_feature [331]..[331]: Chromosome 8, SNP identification no. = rs7842552
  misc_feature [331]..[331]: allele = g, in linkage disequilibrium with rs7014346, respectively
  misc_feature [331]..[331]: n is a, t, c or g
gacacctgtgaactcaatttaccctagaaaaatgtttcagtcacacttaaaataaaaagggcatcaattagaataagaaggacactttgttgcctaggaggactgaacttttttggacctggggcaccttatcagcttcatttttagctctagtataatcaaaaggtcaggatctccactggaccttagaaattttttatttttcgataagattttctgaatgcctgccatgtgtgaagggaaatgcctggacttctatgcatatgtatttcattgtctccccacatctacccaggaagacaggcacagtgagccttgcatgttgtagatnaggaagctaagtctcaaagacagagaaggaatttctcaaggtcacactgtaagtaaaaggcaaaggagggattagaaccctggatcctctttattacaccaagcctgcctcacaaggatgccaatctctcatcacttactgggaaagacccactcctcccattcatgataaggtaatgctatccaataaaaaccccaaagcaggcataaaatatgaagtagcgaaactcaggcaggcagaaagcagagtggtttagacatggctgctgtctgcagcagggagaagttcctggcaacatgaccctgaaaataacaatgagtgactgaagct

SEQ ID NO: 1106 - DNA, 661 bp, Homo sapiens
  misc_feature [331]..[331]: Chromosome 8, SNP identification no. = rs9297756
  misc_feature [331]..[331]: allele = a, in linkage disequilibrium with rs10505473, respectively
  misc_feature [331]..[331]: n is a, t, c or g
gagtggaagacggacaataaataaatagatgtgtattgtgacaagtgtcaataagagctatgaaggacaacaaaacatagtaaagagatgaggaaggctggagaggccaaggcatccatttaaataaggtcatcggggcaaggctctgagagggtggcatggaagggagacctgaaagaaaggagggagaaaccacatgttttcgttcctctccacacactgccaccaaactatttctcctatagccttcccaagctcagtaaatgataattccactctaggagttttccagctcaaaaacctcactgtcagccttgactccttccttcanacccatgccatgccaactgtagatgcagccagctctgtggatatctgggaaggaggcttccaggtggagaatagcaaggtcaaaggctgaagggaggaagctccctggcctgctgtggacagtgaggaggccgagatgctagagaaggacagtgagagaaggccagaggatcagctgaggtcactcacctgggactttgtggaccagattaaggaatttttagttttcctctcaggaagaagggaagtcattggagatgtgtggacagaggagtgtcatgctctgaattgtgttagaaaggaatcactctggctgctctatggagaagag

SEQ ID NO: 1107 - DNA, 661 bp, Homo sapiens
  misc_feature [331]..[331]: Chromosome 8, SNP identification no. = rs7357368
  misc_feature [331]..[331]: allele = t, in linkage disequilibrium with rs10505473, respectively
  misc_feature [331]..[331]: n is a, t, c or g
tgagtgggttgcttattgtcaacaagtcctgagggacagagtcagtaattgagatcagagttgggggctcttgtccaagcttctcccacaaccgcattctggggcacttcgtggagaaatgccactcagcaatctgcattcagctctgctgttgctgtggttttcaaattggctacacatcaaaaaacacgtgagaatcttgtcagccacagatttctaagcctcacctcagaggttctgattctctgggtatggcatgggccccagaggtctagatttttgcatcaggtaactatgaatattccaggtccctgccttcatacaaagcacnatgaggtgataagtattacattttcttgttcctggtcctagggttcatatttagcttaattctataaaataaaaacttcggacatttaacataccctgcctcatttgatagggttgtccatgaaattgagagacagtggaaaactcattgatcttgctatttaccatgagtcgtagacctagtaacttagcctctccgagtttcagtgtctccattattgaaagcagggcttatagtaactactctctagagatatgaaattcaaataccataatatgtgtattagctgtagtagtagccatttatcagagcaggagatgaagggcacag

SEQ ID NO: 1108 - DNA, 661 bp, Homo sapiens
  misc_feature [331]..[331]: Chromosome 8, SNP identification no. = rs7831606
  misc_feature [331]..[331]: allele = a, in linkage disequilibrium with rs10505473, respectively
  misc_feature [331]..[331]: n is a, t, c or g
tcctacctcagcctcccaagtagctgggactacaggcgcccgccaccacacccggctaattttttgtatttttagtagagacggggtttcgccgtgttaaccaggatggtctcgatctcctgacctcatgatccgcccaccttggcctcccaaagtgctgggattacagatgtgagccaccgtgtctggccattaagttaaatttattaataattaacaaatacgttaattaatattgaataaaggaattttatttgggcttcagtctttctgggctcctcacagttacaaaaatacagcatacccttctggttctcaaggagtttccaangcagatctctgatctggagtgcctctcttcctttttgccctgaaggtagtcagtgaggctcatcagaaattttctgattctcttccttccagatacctccttatgcttttgaactcaattgttgccatgggcttgatttggccagtgaaatgtaagtgaaagcaatgtttgtctcttcaggtagaagctgagagccagtgcttactgttgtttcattctctctcttcctcttgtcactttccaaatggtagcggccctatcagcctgggtcctggcatgaagaaacacaaagtaacactctcccaaattacccataacagacatggaata

SEQ ID NO: 1109 - DNA, 661 bp, Homo sapiens
  misc_feature [331]..[331]: Chromosome 8, SNP identification no. = rs4909649
  misc_feature [331]..[331]: allele = c, c, in linkage disequilibrium with rs1399176, rs10505685, respectively
  misc_feature [331]..[331]: n is a, t, c or g
ctctagctgcatccatgttgctacaaagaacataatttcattctttccatgactgcatagtattccatggtgtatatataccacattttctttatgaagcccccagttgctgaacacttaggttgatttcatgcctttattttcttgaatagtgtgcaataaaaatacctgcatgcatatgtttgccccctcttccacctttgtgtttttgttcagtctcctctctgttgttatcttcttgctaaaatcacaaatcttacaatttgaaaatatctctttcttcttagcaatccgtactctcaaagcaacatagcatacttatttttgtctntattttttcatttttttctacagcacatagttctttaatattacaaacatatttaattactattatatattttaaatagtttggggtcaaaatgtttgttcaaaatttctcttgttcctgaacaattgcacaagtacaattgtaaacaaaacatcaattatgattaaattgagcatttgtaacaaatagtaaaaaacaactttaaatagtcactatatgtccttttaaaccaatttcaatgtgatttggcccatggataaaagctgcagagctagggggttatattaaatggaatttctgatccatatactcctatctctttgttatttt

SEQ ID NO: 1110 - DNA, 661 bp, Homo sapiens
  misc_feature [331]..[331]: Chromosome 8, SNP identification no. = rs4909652
  misc_feature [331]..[331]: allele = c, c, in linkage disequilibrium with rs1399176, rs10505685, respectively
  misc_feature [331]..[331]: n is a, t, c or g
tattacaaacatatttaattactattatatattttaaatagtttggggtcaaaatgtttgttcaaaatttctcttgttcctgaacaattgcacaagtacaattgtaaacaaaacatcaattatgattaaattgagcatttgtaacaaatagtaaaaaacaactttaaatagtcactatatgtccttttaaaccaatttcaatgtgatttggcccatggataaaagctgcagagctagggggttatattaaatggaatttctgatccatatactcctatctctttgttattttgtttttgtttattcaaatttatctctagtatgccacaanaatgttcatctagccaaaaacacattaaatatatgctgcaaatatttatttggggagttaaagttctatgatttcccagtggggtacatggagaatccaaagagcaagcaaatttggttgtgaagaaatatcataattttggaattctcttagagctgagggacaggcgagaatatcaggcttacaaaggtcccaaaacatgttgccaagacgaagagccagcccagcttgtacatgcagggaacaaggcagctactccccagaatattcacagaccttcctctagactctctccctaccccagcccctacttactgcgtgaattttatt

SEQ ID NO: 1111 - DNA, 661 bp, Homo sapiens
  misc_feature [331]..[331]: Chromosome 8, SNP identification no. = rs7000235
  misc_feature [331]..[331]: allele = c, c, in linkage disequilibrium with rs1399176, rs10505685, respectively
  misc_feature [331]..[331]: n is a, t, c or g
gaaggtatcacctaacagcttcattggcagatataggtcaagtttatagcccttaggagagctgggagactgtgccacatgggtaagcagagatatggccagtcatcctctcagacccaggtaaatgtcctctaccacatttgttgctaggagacaaataataaaaagtgctctcatccacatctggtagcaatttttaaatggaaataacaataagaagaataatgataataatgataatacctaaatcagatagatgtgtaagagattgtaaaatcataatttctacaatttccaagccatttagttccctggctggatggaacaaaantgcaaaagcatattcaaatattgttaaacataacacctatttatattattaatatcatattgtataaaataaaatagcaactaaaaatttatgcagagaaaattctttcaaaaatcacatttgattatgaccagaatgttatctcacccaaccatttctccatgactgaatctattctgatctcccaagagactatttattctttgcgggaatctcaacaggaaggcatactattcatttcaactgacagttctccaaatactgtaaaaacagaaacaaaaaaacccaaaaccgaaaccaaaccaaaccaaaataaacctatagggtggc

SEQ ID NO: 1112 - DNA, 661 bp, Homo sapiens
  misc_feature [331]..[331]: Chromosome 8, SNP identification no. = rs7833216
  misc_feature [331]..[331]: allele = g, g, in linkage disequilibrium with rs1399176, rs10505685, respectively
  misc_feature [331]..[331]: n is a, t, c or g
gaaaattctttcaaaaatcacatttgattatgaccagaatgttatctcacccaaccatttctccatgactgaatctattctgatctcccaagagactatttattctttgcgggaatctcaacaggaaggcatactattcatttcaactgacagttctccaaatactgtaaaaacagaaacaaaaaaacccaaaaccgaaaccaaaccaaaccaaaataaacctatagggtggcttcagaactcatattcttacctcatactctgattgcttatctgttaataagaaaagcaatctattggaagttcagaagaaaagaatgtcaagcttctnagagtatttattattaatgaaccccctggataaattcaccaaatgcactgtggcagattttaaatggtagagagaaatataagtaagtgggcaacaaagtgaaaataaaggtgagatatttaaaagcagtggcaaatccagaggtatgagagatagtcaaaggaaagatgctgtgggtcgacaccatgggaaactgcaagggcataaacttgagaagcttcttgttgttaaaaaagtcttcccaatgggcatacaaagaatccccacaacatgtgcacacacaaatacacatgcacactcttccaaatcaaatcaaagagcacgtactat

SEQ ID NO: 1113 - DNA, 661 bp, Homo sapiens
  misc_feature [331]..[331]: Chromosome 8, SNP identification no. = rs6986763
  misc_feature [331]..[331]: allele = a, a, in linkage disequilibrium with rs1399176, rs10505685, respectively
  misc_feature [331]..[331]: n is a, t, c or g
ccccctggataaattcaccaaatgcactgtggcagattttaaatggtagagagaaatataagtaagtgggcaacaaagtgaaaataaaggtgagatatttaaaagcagtggcaaatccagaggtatgagagatagtcaaaggaaagatgctgtgggtcgacaccatgggaaactgcaagggcataaacttgagaagcttcttgttgttaaaaaagtcttcccaatgggcatacaaagaatccccacaacatgtgcacacacaaatacacatgcacactcttccaaatcaaatcaaagagcacgtactattcctatctctttcactgtgtcngaaacagttgtccacctctagaggtactgccactacagcattcaaaagatgaatcttgacatcttcatactggatgaattggaagctcatgtatattaaaatatcatgaaactgtgcacccccacggttttatgtaaagcattctattttctgggtatccaccggttgggtaccattgctgaaattttcctctgtgtgattttagctacctggtcatagctacacatggctttcacaagactcactctgcagttataatattttgtcatgttttattactgaagggatagaagaagattgtagaactgcaatatacagcccttgggttca

SEQ ID NO: 1114 - DNA, 661 bp, Homo sapiens
  misc_feature [331]..[331]: Chromosome 8, SNP identification no. = rs4265216
  misc_feature [331]..[331]: allele = c, c, in linkage disequilibrium with rs1399176, rs10505685, respectively
  misc_feature [331]..[331]: n is a, t, c or g
attattattcatactatagttctttctagattcttgtcatgatgataagctttgctagcccacatattttaggtaagaactagaaaaattgagtcacttagccattgtcattaatcatgtcttcagacactcaacatagatcttagaattaggttttccatctaaagaggaaaaaatagtaactattattctcataattttattttattaaaacaattgggtatttatgtatttaacaaatgttgatcaagtacctgttctatacaattacctgtattagattttacataaatgtgtatgtgcacatgcatacacatatgtataaatatgngtgtacataagacataaatatttgatttatgtatatttaatatatgcatatttatgggtatatgtaaacccaaaaaggagtgtgtgtgtgtttgtgtgtattatttgatatagggacctcaagacagcaaatgttcaataacaattgttattttctccccatggtttgagaagatttaatgcttctggagcttaaagccacgttagtttttgtgagatagggttacaataaagtatcctataaatacagagatgtcaaaaaaaagtgactggtcacaaatttacctccttgtggagatgggggatagtatgaagacgtattctgtacacc

SEQ ID NO: 1115 - DNA, 661 bp, Homo sapiens
  misc_feature [331]..[331]: Chromosome 8, SNP identification no. = rs4391470
  misc_feature [331]..[331]: allele = a, a, in linkage disequilibrium with rs1399176, rs10505685, respectively
  misc_feature [331]..[331]: n is a, t, c or g
acaaatgttgatcaagtacctgttctatacaattacctgtattagattttacataaatgtgtatgtgcacatgcatacacatatgtataaatatgcgtgtacataagacataaatatttgatttatgtatatttaatatatgcatatttatgggtatatgtaaacccaaaaaggagtgtgtgtgtgtttgtgtgtattatttgatatagggacctcaagacagcaaatgttcaataacaattgttattttctccccatggtttgagaagatttaatgcttctggagcttaaagccacgttagtttttgtgagatagggttacaataaagtntcctataaatacagagatgtcaaaaaaaagtgactggtcacaaatttacctccttgtggagatgggggatagtatgaagacgtattctgtacaccaaaaataacacatctaaatacacagaggcaaaaaacatgtaacacttttttttttttagtttacactgagatatttagcaaagttgagcatgtttgcttcggttaaatgttgaaaaaggagcaaaactcttagttctatatcagcaaatgcaatattacagtggcttaactcctgtataaacattaggagctcagaagccctgggctgctgtgacagctttgcagtcatcacaga

SEQ ID NO: 1116 - DNA, 661 bp, Homo sapiens
  misc_feature [331]..[331]: Chromosome 8, SNP identification no. = rs13249389
  misc_feature [331]..[331]: allele = a, a, in linkage disequilibrium with rs1399176, rs10505685, respectively
  misc_feature [331]..[331]: n is a, t, c or g
gtatcctataaatacagagatgtcaaaaaaaagtgactggtcacaaatttacctccttgtggagatgggggatagtatgaagacgtattctgtacaccaaaaataacacatctaaatacacagaggcaaaaaacatgtaacacttttttttttttagtttacactgagatatttagcaaagttgagcatgtttgcttcggttaaatgttgaaaaaggagcaaaactcttagttctatatcagcaaatgcaatattacagtggcttaactcctgtataaacattaggagctcagaagccctgggctgctgtgacagctttgcagtcatcacngatgggggttctttgtacttttcttttttaagcatcaatttgtatttcaaaattactgctggaaatccagtcatctccatattacaggaagggggaaaagagcagaagggcatgagctgactcctttttgaataagctgcttttgagggggcttccaggttgcccctggaattatagtcagcctatatttaatagaacacaccttactgaaaggcaggagtacgtctattttaactgggtgtattgttacccggataaaactatgaatctgtcattaaggacaataaaagttgtttaggcagttaaaagttttgaaaaaaaaaaaaacct

SEQ ID NO: 1117 - DNA, 661 bp, Homo sapiens
  misc_feature [331]..[331]: Chromosome 8, SNP identification no. = rs10102751
  misc_feature [331]..[331]: allele = g, g, in linkage disequilibrium with rs1399176, rs10505685, respectively
  misc_feature [331]..[331]: n is a, t, c or g
aaagttttgaaaaaaaaaaaaaccttcagggatgacgttgtttctaatggtcacctactatagatgttttatggtcaaagttagaatcgttgacctatgacgtttcatctagtctccacactgaaaataagaaatatcttcatcattagaaagattagaaatctaaattttggaggtgtttaaatatttgtccaagatcacatcaggagcaaatgacagcatcaatttttaacctagatcttcctgaagccaaaccctcatcctaccacataacacagtcttggtaaattaatgcaggaaagaccctctgttcccatgaaaggggcaatanctttcaaaattgttgcataagtaataatttagatactctgttttgtctgataagttattgaataatttcataagaggataataatgtatgtctccattaaataaactttggggtaattataattttacttataagctacttaactcatgttcactggagcatacttttcctaaattgccactgcatatttttatgatattaattctgaatattttggtagtcatgagggcttcagattttctcaagaaagctggagtaatggctgtactggcacctgtcagagcgtctgggtactaaggtgccgtagcaaacaatgtaaaaatggacacc

SEQ ID NO: 1118 - DNA, 661 bp, Homo sapiens
  misc_feature [331]..[331]: Chromosome 8, SNP identification no. = rs4532628
  misc_feature [331]..[331]: allele = t, t, in linkage disequilibrium with rs1399176, rs10505685, respectively
  misc_feature [331]..[331]: n is a, t, c or g
caatgtaaaaatggacacctcctttagcctgtggctagtgtcacccaaatttgcagataccacctctttcctaggacaaggtttaatttcatagaaacaaaaccatcttttctctttcttggaagtatttgcaagacctgggtctctgtttcctgcttcttatactctaagataccctaattataacccataaaaatacaagggctgtcccctccataaggaaggcaaagcttctcacctatgctttggagttctttctctttcatctttctcaaactccgttgacattctcttctctctctgttatatttagttcttccctttaacttcngcttctttcaactagctattacacacataaatctttccaatttgaacacaagcacctaaaaaggttttattgacctcatgtacccctccagctaggacttcccgcttccatttcacagtccgctgttattttaaataggtgcctctaacctcatactccatttcttcccctcccagtctgactccaataggaattcctccccattactcagataatagctctgccaaggttgctaatgactggtgtgtccttacttcttcaaccaaaatcatttggtcctcacatttcttgagccctaagcaagacttaacccaactgatcacttcctcc

SEQ ID NO: 1119 - DNA, 661 bp, Homo sapiens
  misc_feature [331]..[331]: Chromosome 8, SNP identification no. = rs4279630
  misc_feature [331]..[331]: allele = c, c, in linkage disequilibrium with rs1399176, rs10505685, respectively
  misc_feature [331]..[331]: n is a, t, c or g
aatttcatagaaacaaaaccatcttttctctttcttggaagtatttgcaagacctgggtctctgtttcctgcttcttatactctaagataccctaattataacccataaaaatacaagggctgtcccctccataaggaaggcaaagcttctcacctatgctttggagttctttctctttcatctttctcaaactccgttgacattctcttctctctctgttatatttagttcttccctttaacttctgcttctttcaactagctattacacacataaatctttccaatttgaacacaagcacctaaaaaggttttattgacctcatgtacncctccagctaggacttcccgcttccatttcacagtccgctgttattttaaataggtgcctctaacctcatactccatttcttcccctcccagtctgactccaataggaattcctccccattactcagataatagctctgccaaggttgctaatgactggtgtgtccttacttcttcaaccaaaatcatttggtcctcacatttcttgagccctaagcaagacttaacccaactgatcacttcctcctttgaaacactttattttcctctgcttccatcttatcctactgttctgatttttctcctaagtctcaagctacttctgtttgtc

SEQ ID NO: 1120 - DNA, 661 bp, Homo sapiens
  misc_feature [331]..[331]: Chromosome 8, SNP identification no. = rs4474054
  misc_feature [331]..[331]: allele = g, g, in linkage disequilibrium with rs1399176, rs10505685, respectively
  misc_feature [331]..[331]: n is a, t, c or g
aagtatttgcaagacctgggtctctgtttcctgcttcttatactctaagataccctaattataacccataaaaatacaagggctgtcccctccataaggaaggcaaagcttctcacctatgctttggagttctttctctttcatctttctcaaactccgttgacattctcttctctctctgttatatttagttcttccctttaacttctgcttctttcaactagctattacacacataaatctttccaatttgaacacaagcacctaaaaaggttttattgacctcatgtacccctccagctaggacttcccgcttccatttcacagtccnctgttattttaaataggtgcctctaacctcatactccatttcttcccctcccagtctgactccaataggaattcctccccattactcagataatagctctgccaaggttgctaatgactggtgtgtccttacttcttcaaccaaaatcatttggtcctcacatttcttgagccctaagcaagacttaacccaactgatcacttcctcctttgaaacactttattttcctctgcttccatcttatcctactgttctgatttttctcctaagtctcaagctacttctgtttgtctcactctaacccttctctaacagcttattatttattgc

SEQ ID NO: 1121 - DNA, 661 bp, Homo sapiens
  misc_feature [331]..[331]: Chromosome 8, SNP identification no. = rs4909654
  misc_feature [331]..[331]: allele = c, c, in linkage disequilibrium with rs1399176, rs10505685, respectively
  misc_feature [331]..[331]: n is a, t, c or g
aagtctcaagctacttctgtttgtctcactctaacccttctctaacagcttattatttattgctgcctctgcaagctcaatcataggccctgtccttctcaggataactttatccacaaccacagccttaattggcctctgtgcacaggtggagcccacatttataagtcgagcagctatttccttcctgtgctttccttaattgtctggaagtcacgtaaaattcaagatatctaagaacaaactcaacattgttcattctcaaattggtcctcttccagtaattaaggaatgctacctccatttactcagatacattagtgtttctccntttcacctctcatcagaattaaaaaactaattgttttattaagttcacctcaatatatcccatcttttttttcccagcaccagaccacattggtctacattatcattttctctcatgtggacgcctgcagtcttctcctaattgaactactcacattccctactctatttgcaaggcctctctcctcctcacccttaccctatttccatctgttctctgtaatacagccaagagaattaatctcatcacaaacccacacactgacaatggctccacactgctctgaagatcaaaaccaaaatgctgaacatggctgcgactctctacttt

SEQ ID NO: 1122 - DNA, 661 bp, Homo sapiens
  misc_feature [331]..[331]: Chromosome 8, SNP identification no. = rs4292724
  misc_feature [331]..[331]: allele = c, c, in linkage disequilibrium with rs1399176, rs10505685, respectively
  misc_feature [331]..[331]: n is a, t, c or g
tctactttccctgaccctcgcttctcttgcaccatctgacaccatcttcctatgcccactgggtgtatttcagtttcagacattctgaatttatgctgcagggtcccttctactgcaaagctactgcgacacaggagttctcctttcggtgtcctcttttctagtccaagtccaacttcacctcatttatggactctgccttgacctgaattcaagacctttgttaaatcgaagaagtttttcctaccctctacactaagtcagatctcattgttatacaaaataataacaagtgacacttgccatattacaaaacagggaaaggcagccnatcttaactgataatgcattgttaacactgtgcaggttcaacgacataaaaacctcgcaaagaacagggctacctttatttatttaacattgtaggtctggtggaatcacctttctgttcttctcctgaggaattattgtcctatctgtttctttttctttttcagcagtttctgaccgaaatggctttctcaaattcagaggtttccaaaagggaagggctgccttacttccttacttgtggtgaattcttccttactggccatgtttgtcaccctgctgtgactggttccaattagcaaactcttcttcctttctttttttttttttt

SEQ ID NO: 1123 - DNA, 661 bp, Homo sapiens
  misc_feature [331]..[331]: Chromosome 8, SNP identification no. = rs12541665
  misc_feature [331]..[331]: allele = g, g, in linkage disequilibrium with rs1399176, rs10505685, respectively
  misc_feature [331]..[331]: n is a, t, c or g
cctaccctctacactaagtcagatctcattgttatacaaaataataacaagtgacacttgccatattacaaaacagggaaaggcagcccatcttaactgataatgcattgttaacactgtgcaggttcaacgacataaaaacctcgcaaagaacagggctacctttatttatttaacattgtaggtctggtggaatcacctttctgttcttctcctgaggaattattgtcctatctgtttctttttctttttcagcagtttctgaccgaaatggctttctcaaattcagaggtttccaaaagggaagggctgccttacttccttacttgtngtgaattcttccttactggccatgtttgtcaccctgctgtgactggttccaattagcaaactcttcttcctttctttttttttttttttttttttgagacagagtcttgctctgtcatccaggctggagtgaggagtgagtggcaccatctcggctcactgaaacctctgcctcccgggttcaagcgattctcctgcctcagcctccagagtagctgggactacgggcacgtgccaacatgtccagctaattttttgtagagatggggtttcagcatattagccaggatggtcttgatctcctgaccccgtgatctgcctgcctcggcct

SEQ ID NO: 1124 - DNA, 661 bp, Homo sapiens
  misc_feature [331]..[331]: Chromosome 8, SNP identification no. = rs4909657
  misc_feature [331]..[331]: allele = a, a, in linkage disequilibrium with rs1399176, rs10505685, respectively
  misc_feature [331]..[331]: n is a, t, c or g
ggagtgaggagtgagtggcaccatctcggctcactgaaacctctgcctcccgggttcaagcgattctcctgcctcagcctccagagtagctgggactacgggcacgtgccaacatgtccagctaattttttgtagagatggggtttcagcatattagccaggatggtcttgatctcctgaccccgtgatctgcctgcctcggcctcccaaagttctgggatgaagtttgggttacaggcgtgaaccaccatgcccagtaacttcttctttcattccaaacctggtgaggccataattagtactagttttgcttaaaccttctaaagtggantaatattacctttaaaatggcaaaaactggtcttgcgggggggaaattttctctttttatatataaattacagatatatatagagagtacataaatgaagatatagcatatttgtaatatcaaagtttgataaggtgaaggaatgagtagagaaaatgatgtctaagaagacttcttgatggggacaataatgaaaaagactgcaaaacattgagttagatcctgcaaccacttcccttcatttccattccctgctcccagtagaaaaaatcccactacttttaaagagatggcttgccaagtcccagcacagttgaaaattcttaaaac

SEQ ID NO: 1125 - DNA, 661 bp, Homo sapiens
  misc_feature [331]..[331]: Chromosome 8, SNP identification no. = rs4909367
  misc_feature [331]..[331]: allele = t, t, in linkage disequilibrium with rs1399176, rs10505685, respectively
  misc_feature [331]..[331]: n is a, t, c or g
catgtccagctaattttttgtagagatggggtttcagcatattagccaggatggtcttgatctcctgaccccgtgatctgcctgcctcggcctcccaaagttctgggatgaagtttgggttacaggcgtgaaccaccatgcccagtaacttcttctttcattccaaacctggtgaggccataattagtactagttttgcttaaaccttctaaagtggaataatattacctttaaaatggcaaaaactggtcttgcgggggggaaattttctctttttatatataaattacagatatatatagagagtacataaatgaagatatagcatatntgtaatatcaaagtttgataaggtgaaggaatgagtagagaaaatgatgtctaagaagacttcttgatggggacaataatgaaaaagactgcaaaacattgagttagatcctgcaaccacttcccttcatttccattccctgctcccagtagaaaaaatcccactacttttaaagagatggcttgccaagtcccagcacagttgaaaattcttaaaacttgcttctgagcagaacaaagtctgatgcaaaccatttttttattttttatttttgtttttggagacgaagtttcactcttgtcgcccaggctggagtgccacggtgcgatc

SEQ ID NO: 1126 - DNA, 661 bp, Homo sapiens
  misc_feature [331]..[331]: Chromosome 8, SNP identification no. = rs7820493
  misc_feature [331]..[331]: allele = t, t, in linkage disequilibrium with rs1399176, rs10505685, respectively
  misc_feature [331]..[331]: n is a, t, c or g
gttctgggatgaagtttgggttacaggcgtgaaccaccatgcccagtaacttcttctttcattccaaacctggtgaggccataattagtactagttttgcttaaaccttctaaagtggaataatattacctttaaaatggcaaaaactggtcttgcgggggggaaattttctctttttatatataaattacagatatatatagagagtacataaatgaagatatagcatatttgtaatatcaaagtttgataaggtgaaggaatgagtagagaaaatgatgtctaagaagacttcttgatggggacaataatgaaaaagactgcaaaacantgagttagatcctgcaaccacttcccttcatttccattccctgctcccagtagaaaaaatcccactacttttaaagagatggcttgccaagtcccagcacagttgaaaattcttaaaacttgcttctgagcagaacaaagtctgatgcaaaccatttttttattttttatttttgtttttggagacgaagtttcactcttgtcgcccaggctggagtgccacggtgcgatctcggctcactgcaacctctgcctcgcaggttcaagtgattctcctgcctcagcctcctgagtagctgggattacaggtgtgtgccaccatgcctcgcta

SEQ ID NO: 1127 - DNA, 661 bp, Homo sapiens
  misc_feature [331]..[331]: Chromosome 8, SNP identification no. = rs7837229
  misc_feature [331]..[331]: allele = g, g, in linkage disequilibrium with rs1399176, rs10505685, respectively
  misc_feature [331]..[331]: n is a, t, c or g
acaacccttttaacctagatatgaaacatctacttaaattatgtctaccatgatgagaattgaccaagtctgcaaagatttcagacattaaacttcatgtccacctttatactcatatttctttaacatagtacctgcctccaagcagaagctaaacgtctgacaataaataaaacaggaggcacattttattgaacgtctactatacaaagacactggggttgtattttaatcttctagacttaaaataacccttgggtgttagtgttattactcccatgctatagacaaggcatatgaagaggctatgtaaattgtgatcaaacttacncagctagaacaggacaggcccaggagtaggactaagttctgtttgtctccaagtctccccattttgcattataggatcaaacaccaacaccttcaagaatgcactaattctggtgtattaaacttaacagagccatgtcttatctgtttcatgtgctatctcagtttattaacatttatgaaaagccatttagcaacctagctctgattaagaaaatcgacacctgtactttgactcccttcacagggatgaaaactcttcatctaatgaatcaataatcaatttttaatgcactggcaggttgaacagagaaatgcagtaaaaccttag

SEQ ID NO: 1128 - DNA, 661 bp, Homo sapiens
  misc_feature [331]..[331]: Chromosome 8, SNP identification no. = rs13253269
  misc_feature [331]..[331]: allele = c, c, in linkage disequilibrium with rs1399176, rs10505685, respectively
  misc_feature [331]..[331]: n is a, t, c or g
tagtgagttctagatagatttttattaaggaacaagatcttcagaaatttattttagccagaagcacatgatttctccagtccatttattagcatcaaaataataccactgtgatggttaactttatgtgtcaattgaccgagccacagggtgctcaggtacttggttgaacattattctcagtatgtctgtgaggaagttgttggataaaattaacatttaaattagcagattgagtaaagaagattaccctcactcatgtaggcaggcctcatccaatcacttgaaagactgaatggaccaaaaattctgaccctcctctgagataganaggattcctcttgctgatggcattctggctggaacatgagctttttcctgccttcgtacttgacctgaaacatcagctcttctgggttttcaccctgtagatcttggaatttgtcagtctccatagtcacctgagccaatactgtataataaatctctttatgtatgcatgtatatatatatagacagatatacatatttgtctatctacatacgtagagaaccaattgatttacatagatagaaatacatttcataggttttctctctctctctctctgtgtatatatatatttattcatatttatatgtttgtcatatattgaaatgg

SEQ ID NO: 1129 - DNA, 661 bp, Homo sapiens
  misc_feature [331]..[331]: Chromosome 8, SNP identification no. = rs7014387
  misc_feature [331]..[331]: allele = c, c, in linkage disequilibrium with rs1399176, rs10505685, respectively
  misc_feature [331]..[331]: n is a, t, c or g
catttattagcatcaaaataataccactgtgatggttaactttatgtgtcaattgaccgagccacagggtgctcaggtacttggttgaacattattctcagtatgtctgtgaggaagttgttggataaaattaacatttaaattagcagattgagtaaagaagattaccctcactcatgtaggcaggcctcatccaatcacttgaaagactgaatggaccaaaaattctgaccctcctctgagatagacaggattcctcttgctgatggcattctggctggaacatgagctttttcctgccttcgtacttgacctgaaacatcagctcttntgggttttcaccctgtagatcttggaatttgtcagtctccatagtcacctgagccaatactgtataataaatctctttatgtatgcatgtatatatatatagacagatatacatatttgtctatctacatacgtagagaaccaattgatttacatagatagaaatacatttcataggttttctctctctctctctctgtgtatatatatatttattcatatttatatgtttgtcatatattgaaatggtttgcctctttgtccccacccaaatctcgtctcaaattgtaattcccacgtgttcagggaaagacctgctgagagtgattgg

SEQ ID NO: 1130 - DNA, 661 bp, Homo sapiens
  misc_feature [331]..[331]: Chromosome 8, SNP identification no. = rs7826913
  misc_feature [331]..[331]: allele = a, a, in linkage disequilibrium with rs1399176, rs10505685, respectively
  misc_feature [331]..[331]: n is a, t, c or g
atcagctcttctgggttttcaccctgtagatcttggaatttgtcagtctccatagtcacctgagccaatactgtataataaatctctttatgtatgcatgtatatatatatagacagatatacatatttgtctatctacatacgtagagaaccaattgatttacatagatagaaatacatttcataggttttctctctctctctctctgtgtatatatatatttattcatatttatatgtttgtcatatattgaaatggtttgcctctttgtccccacccaaatctcgtctcaaattgtaattcccacgtgttcagggaaagacctgctgngagtgattggatcatgaaggcagtttcccccatgctgttctcgtgatagtgagtgagttctcagtagatctgatggtttaaaagtggcagtttccccttcactctctctttcctgacaccatgtaagatgtaccttgcttccccttagcctttagccatgattgtgagtttcctgaagcctccccagccatgcagaactgtgagtcaattaaaccttttttctttttaaattacccagtctcaagtagtttctttatagctgagtgaaaatgaactaatacaaatgtttttctcataggttttacttttctatgaaatcatgactaatac

SEQ ID NO: 1131 - DNA, 661 bp, Homo sapiens
  misc_feature [331]..[331]: Chromosome 8, SNP identification no. = rs6577786
  misc_feature [331]..[331]: allele = t, t, in linkage disequilibrium with rs1399176, rs10505685, respectively
  misc_feature [331]..[331]: n is a, t, c or g
tctcataggttttacttttctatgaaatcatgactaatacagttaccttgtatttttgtgattgtatttgttttatattcatgaatacatgatttacggaacttattgtattttcttcaaaaaattatttagtcctacctgaacagaataaaatcgtccattttctgtgctgtagtctgtgcactctagcctttatgtgggaacttcctctaaatgaagattctcaagtcatagctcagatatattaaatcagaatctgcattggtaacaatgagcaagtgatttgtatgaacatttatgtctgataagctccagcacagggaacttgaantttagcctggctatatgctctgtgatatttagtatgtcagtgtagccatctggacctcattttctttatttctgaggatttggtcaatcaggtacttaggatagagcttgacatagaatagaaaatcattatgatacagctagtaacaagaggcacagatagtagtataagaagtaacaacagcaaaatacaaaaataatagcataccagagagaactttaatttaacaagaaaggatcctgtatctgggtttgagtactagccttgatggttaaatgactttacgtcattttagctcctaagccttgtgtcccctacttctaaattcat

SEQ ID NO: 1132 - DNA, 661 bp, Homo sapiens
  misc_feature [331]..[331]: Chromosome 8, SNP identification no. = rs7835685
  misc_feature [331]..[331]: allele = t, t, in linkage disequilibrium with rs1399176, rs10505685, respectively
  misc_feature [331]..[331]: n is a, t, c or g
caacagcaaaatacaaaaataatagcataccagagagaactttaatttaacaagaaaggatcctgtatctgggtttgagtactagccttgatggttaaatgactttacgtcattttagctcctaagccttgtgtcccctacttctaaattcatgctgctggaccaagtacatttgtgtgtcgttatacagggaggtttgactctgcttagagagcagctatacccatttcatcactcacttagtgtatccttcctgagcttaaatgttctgctttagacagtgtctacttggccaacctataagcaccagaaaataataatgggcattacntgagcatggttgacatcagtgagaagaggagaagccacccacagacccctttgcctctaattcatttctaacctgtggcaataggcagataagaggatgctcactcatcatagttaacatgctataacatcacaccactgaaacaaatgtcatctgatacttcatcatctaaattctatttcaggatcacagggatactcctgaggcattgtcttacttgaaaaatgttatttcaattagttgcatatcactctttacaggatttaggtcaaatgaggggcagtactaaatccaaaccaaacaatatgtgtctgcaataaatttctgttc

SEQ ID NO: 1133 - DNA, 661 bp, Homo sapiens
  misc_feature [331]..[331]: Chromosome 8, SNP identification no. = rs4909658
  misc_feature [331]..[331]: allele = t, t, in linkage disequilibrium with rs1399176, rs10505685, respectively
  misc_feature [331]..[331]: n is a, t, c or g
gggatactcctgaggcattgtcttacttgaaaaatgttatttcaattagttgcatatcactctttacaggatttaggtcaaatgaggggcagtactaaatccaaaccaaacaatatgtgtctgcaataaatttctgttcctgaattattcatatgtaatggcataggtgactcttcaagcattctgaattaagtagaattgatttctcacttttttatgctctgttgtacaagcctttttgtacttttacttcttcttaacaaataaagtattgattcatctccactgaacatgttttatttaaactttggtctttgtcagcaactttgtnattggtacccacaattcccttttgtaacttcccaattgtctttaattctgaaggtgaaatctgttaacctggctgcttagcatgaagtaactgcagagtgggttaaaaatttggcaagaacaatatcacagtgacttttttgccttgcctttgagtttttactccattaccactccccactccccaaaaatatccttcaaatttttattccatttggatgatttaggaattaccatcggacttgaattgcattgtgtttttattggaaaaccatcaaatctcttctttctaaatccttgaacaagcatgtctgtaggtagatgggtgcag

SEQ ID NO: 1134 - DNA, 661 bp, Homo sapiens
  misc_feature [331]..[331]: Chromosome 8, SNP identification no. = rs4909659
  misc_feature [331]..[331]: allele = t, t, in linkage disequilibrium with rs1399176, rs10505685, respectively
  misc_feature [331]..[331]: n is a, t, c or g
tttacaggatttaggtcaaatgaggggcagtactaaatccaaaccaaacaatatgtgtctgcaataaatttctgttcctgaattattcatatgtaatggcataggtgactcttcaagcattctgaattaagtagaattgatttctcacttttttatgctctgttgtacaagcctttttgtacttttacttcttcttaacaaataaagtattgattcatctccactgaacatgttttatttaaactttggtctttgtcagcaactttgttattggtacccacaattcccttttgtaacttcccaattgtctttaattctgaaggtgaaatcngttaacctggctgcttagcatgaagtaactgcagagtgggttaaaaatttggcaagaacaatatcacagtgacttttttgccttgcctttgagtttttactccattaccactccccactccccaaaaatatccttcaaatttttattccatttggatgatttaggaattaccatcggacttgaattgcattgtgtttttattggaaaaccatcaaatctcttctttctaaatccttgaacaagcatgtctgtaggtagatgggtgcaggaaactgggtacaacagtaatcccagcatgaagcacacagcctgaatcaaaattaaaacttg

SEQ ID NO: 1135 - DNA, 661 bp, Homo sapiens
  misc_feature [331]..[331]: Chromosome 8, SNP identification no. = rs4909660
  misc_feature [331]..[331]: allele = c, c, in linkage disequilibrium with rs1399176, rs10505685, respectively
  misc_feature [331]..[331]: n is a, t, c or g
cctttttgtacttttacttcttcttaacaaataaagtattgattcatctccactgaacatgttttatttaaactttggtctttgtcagcaactttgttattggtacccacaattcccttttgtaacttcccaattgtctttaattctgaaggtgaaatctgttaacctggctgcttagcatgaagtaactgcagagtgggttaaaaatttggcaagaacaatatcacagtgacttttttgccttgcctttgagtttttactccattaccactccccactccccaaaaatatccttcaaatttttattccatttggatgatttaggaattancatcggacttgaattgcattgtgtttttattggaaaaccatcaaatctcttctttctaaatccttgaacaagcatgtctgtaggtagatgggtgcaggaaactgggtacaacagtaatcccagcatgaagcacacagcctgaatcaaaattaaaacttgataaatatttgtcaagaaaatgaataaatttaatttttactggggtttatgtcttctaaaaacaattgacagaccatgagtcaggaagcagagcatctagcttataattattagttcacttcgtagcactcaagttttatacaaaaataaaatcttgaagaattgaattaa

SEQ ID NO: 1136 - DNA, 661 bp, Homo sapiens
  misc_feature [331]..[331]: Chromosome 8, SNP identification no. = rs6577788
  misc_feature [331]..[331]: allele = a, a, in linkage disequilibrium with rs1399176, rs10505685, respectively
  misc_feature [331]..[331]: n is a, t, c or g
agctcttactcgtgcagtccattgcaaactggccacagtacgtggccttcaaagcaaattttcccttgtcaaagggactgctgcagatgcccattgagtcacacccccaggtacattgcatagacaatcccaggccattctttcttctgcagaacactgccatgtacgtagattaatcctctgttcttttgtcctgctccaaatatattggttattcagcatgtggaaatcacttttctttgtaagccaaaggcctgagctgctgcacaagaccatgtcagcttcctggttttctccttcagtaaagagtcagatgcacatgtgtcaaagncattctctgtaatatgtgctactacgataggtgctgatgatagaggggtgaattgagcacagctcctatgctggagaacttttagcctgataggaggcatataaatgcaggcatttccctacaaacagacaattgctttccccgtggatatttcctatacaaacaggtaatttctctaggcaatcacctatattggctgtggagtggaacaccaaggccctcttctgctttgcattacactctgaaatcaatgctactaaggccacatgacctttactcttacacattttgatgggacaacttattttcattcccttcccagctctaact

SEQ ID NO: 1137 - DNA, 661 bp, Homo sapiens
  misc_feature [331]..[331]: Chromosome 8, SNP identification no. = rs6577789
  misc_feature [331]..[331]: allele = g, g, in linkage disequilibrium with rs1399176, rs10505685, respectively
  misc_feature [331]..[331]: n is a, t, c or g
gtccattgcaaactggccacagtacgtggccttcaaagcaaattttcccttgtcaaagggactgctgcagatgcccattgagtcacacccccaggtacattgcatagacaatcccaggccattctttcttctgcagaacactgccatgtacgtagattaatcctctgttcttttgtcctgctccaaatatattggttattcagcatgtggaaatcacttttctttgtaagccaaaggcctgagctgctgcacaagaccatgtcagcttcctggttttctccttcagtaaagagtcagatgcacatgtgtcaaagacattctctgtaatatntgctactacgataggtgctgatgatagaggggtgaattgagcacagctcctatgctggagaacttttagcctgataggaggcatataaatgcaggcatttccctacaaacagacaattgctttccccgtggatatttcctatacaaacaggtaatttctctaggcaatcacctatattggctgtggagtggaacaccaaggccctcttctgctttgcattacactctgaaatcaatgctactaaggccacatgacctttactcttacacattttgatgggacaacttattttcattcccttcccagctctaacttcccacatgaattatc

SEQ ID NO: 1138 - DNA, 661 bp, Homo sapiens
  misc_feature [331]..[331]: Chromosome 8, SNP identification no. = rs7845225
  misc_feature [331]..[331]: allele = a, a, in linkage disequilibrium with rs1399176, rs10505685, respectively
  misc_feature [331]..[331]: n is a, t, c or g
cccgtggatatttcctatacaaacaggtaatttctctaggcaatcacctatattggctgtggagtggaacaccaaggccctcttctgctttgcattacactctgaaatcaatgctactaaggccacatgacctttactcttacacattttgatgggacaacttattttcattcccttcccagctctaacttcccacatgaattatctagaggacagaccattagcgaaatatgaatactaaacagtgggttctacccaaagtccttcctctggtactcaactttgcattgagataagtttccactgcctgtgaatttcttttcttaggatnaattccctccccagtgggtccacagcgtctttctcagaaaaaaaaaatgactcctttctttttcttggcaatgttctagtgaggaatacgtacaaacacttgccctgttgacatttcctcttgccttctctatgttctttacctttacacctgaattatcccttacatctgcttggtaaaataccttggacactctacctgaccgttttataaatcaatttctccattaaacagcatttgtagcatgacattccttgttgttccccgacccttcatccctacataccgcttctatagaaagaagctttgattcccaaatcatctttaaaa

SEQ ID NO: 1139 - DNA, 661 bp, Homo sapiens
  misc_feature [331]..[331]: Chromosome 8, SNP identification no. = rs7827162
  misc_feature [331]..[331]: allele = g, g, in linkage disequilibrium with rs1399176, rs10505685, respectively
  misc_feature [331]..[331]: n is a, t, c or g
tcttggcaatgttctagtgaggaatacgtacaaacacttgccctgttgacatttcctcttgccttctctatgttctttacctttacacctgaattatcccttacatctgcttggtaaaataccttggacactctacctgaccgttttataaatcaatttctccattaaacagcatttgtagcatgacattccttgttgttccccgacccttcatccctacataccgcttctatagaaagaagctttgattcccaaatcatctttaaaaagatacttctgaccccttttgttattcactttaatttctagttttgcctacttttttctagancaaaccacaaacaaaatacctgtaaatggatttcaaaatatatgtttagaggagacctcccaaacatatcacctacacacaaataataaaaacccatatctgatgctttgggaaaaatgcttaagttcaccaagttttgggttaaatcttgtgtagaatgcatgtgctagtcaggttttatggactttctctgcatttgtattgttattcagagctgaaaaagctgacccgggactgcagactactaagttgtggcccatgagcaaatcaaacgctccctcaagaggtgagaaatgtgaatgaaaaaaacaataaaataaagtaaaataa

SEQ ID NO: 1140 - DNA, 661 bp, Homo sapiens
  misc_feature [331]..[331]: Chromosome 8, SNP identification no. = rs4131207
  misc_feature [331]..[331]: allele = t, t, in linkage disequilibrium with rs1399176, rs10505685, respectively
  misc_feature [331]..[331]: n is a, t, c or g
cttagaatgggcatataatgtaggaaatacagtatctagaaaaactagaaatgagacactaaatcaaaattaatttttttctccaacaaaagatgtcattagaaaaatgaactggcaagtagtagataagaagatattatttatataaaaaaatctgtatccaatctatattaagaacttgcacatatgaacagacacttcacaaaggaaaatacatgaatgtacaaacatcacacaaaaaaacactcaacaactgtgatcagggaaattcaaatgaaaaccataatgatattccaatatacactcactgaaaagggtaaaattaaaagantgattacaccaaataatgtaattttacactgaagatgtgaaagaaccaaagccatatgacttctaataagttccattaaaaaacacacgtcattattttgatttgattcctagcaaaaatatataacatgagttttatgagaaaaatttagacaaacacaaattcagtaatattaaataactgcactgtactttaaaaacatcaaggtctagaaactctaacaatggctaagaactttcagtttaaaggagattaaaaaatgaccactacaagcaatatgagatcctagtcctgaaaaaagtaaataaacatgaaattattattgtaaca

SEQ ID NO: 1141 - DNA, 661 bp, Homo sapiens
  misc_feature [331]..[331]: Chromosome 8, SNP identification no. = rs4131208
  misc_feature [331]..[331]: allele = c, c, in linkage disequilibrium with rs1399176, rs10505685, respectively
  misc_feature [331]..[331]: n is a, t, c or g
gcatataatgtaggaaatacagtatctagaaaaactagaaatgagacactaaatcaaaattaatttttttctccaacaaaagatgtcattagaaaaatgaactggcaagtagtagataagaagatattatttatataaaaaaatctgtatccaatctatattaagaacttgcacatatgaacagacacttcacaaaggaaaatacatgaatgtacaaacatcacacaaaaaaacactcaacaactgtgatcagggaaattcaaatgaaaaccataatgatattccaatatacactcactgaaaagggtaaaattaaaagattgattacacnaaataatgtaattttacactgaagatgtgaaagaaccaaagccatatgacttctaataagttccattaaaaaacacacgtcattattttgatttgattcctagcaaaaatatataacatgagttttatgagaaaaatttagacaaacacaaattcagtaatattaaataactgcactgtactttaaaaacatcaaggtctagaaactctaacaatggctaagaactttcagtttaaaggagattaaaaaatgaccactacaagcaatatgagatcctagtcctgaaaaaagtaaataaacatgaaattattattgtaacagttgtaaaac

SEQ ID NO: 1142 - DNA, 661 bp, Homo sapiens
  misc_feature [331]..[331]: Chromosome 8, SNP identification no. = rs7016247
  misc_feature [331]..[331]: allele = a, a, in linkage disequilibrium with rs1399176, rs10505685, respectively
  misc_feature [331]..[331]: n is a, t, c or g
aatgaaaaccataatgatattccaatatacactcactgaaaagggtaaaattaaaagattgattacaccaaataatgtaattttacactgaagatgtgaaagaaccaaagccatatgacttctaataagttccattaaaaaacacacgtcattattttgatttgattcctagcaaaaatatataacatgagttttatgagaaaaatttagacaaacacaaattcagtaatattaaataactgcactgtactttaaaaacatcaaggtctagaaactctaacaatggctaagaactttcagtttaaaggagattaaaaaatgaccactacangcaatatgagatcctagtcctgaaaaaagtaaataaacatgaaattattattgtaacagttgtaaaacatggtaaatgttagctgaattttatagtactagtactatctatcaatattaactattctgattttggtacagtattttttaatgcatttttcttattcttataaaaggactttatatctccaagttactgttaaataattcagaaatatttgtgtgtgtgtgcatatcttgagacatatatggagaacgagataaagattaataaagcagattggactatgtgttagtctgttctcacgctgttaataaagacatacctgag

SEQ ID NO: 1143 - DNA, 661 bp, Homo sapiens
  misc_feature [331]..[331]: Chromosome 8, SNP identification no. = rs7007938
  misc_feature [331]..[331]: allele = c, c, in linkage disequilibrium with rs1399176, rs10505685, respectively
  misc_feature [331]..[331]: n is a, t, c or g
ccattcaacaagtctctaggaagttccaaactttccggcatcttcttgtcttctgagccctccaagtctctagaaagttccaaacttttccacattttcctgtcttcttctaagccctccacactattctaatctttgcctgttatccattccaaagtgacttccacattttcagatacctttacagtagcaccctactcctggtaccaatttactatactagttttcacgctgctaataatgacatacccaagactaagtagtttctaaaacaaagaggtttaactgatgcgtagttccacatggctgaagaggcatcacaatcaagatngaaggtgaaaaaaaagcaaaatcacatcttatatggtggtaggcaagagagggtgtgcaggggaactgcccttataaaaccatcagatatcatgagtcttattcactatcacaaaaacagcatgggaaaaacccaccctcatgaatcaattacaacccagttggtccctcccgtgataggtggggattacaggagctacaattcaagatgagattcagttggggacacagccaaaccatatcagaccacatgtcaaaagtgaacgactctaggtaaagggtatatgcttgcttttagtactatttttgtagcttgtctgcaaatctgaaa

SEQ ID NO: 1144 - DNA, 661 bp, Homo sapiens
  misc_feature [331]..[331]: Chromosome 8, SNP identification no. = rs10875404
  misc_feature [331]..[331]: allele = t, t, in linkage disequilibrium with rs1399176, rs10505685, respectively
  misc_feature [331]..[331]: n is a, t, c or g
ctttccggcatcttcttgtcttctgagccctccaagtctctagaaagttccaaacttttccacattttcctgtcttcttctaagccctccacactattctaatctttgcctgttatccattccaaagtgacttccacattttcagatacctttacagtagcaccctactcctggtaccaatttactatactagttttcacgctgctaataatgacatacccaagactaagtagtttctaaaacaaagaggtttaactgatgcgtagttccacatggctgaagaggcatcacaatcaagatcgaaggtgaaaaaaaagcaaaatcacatctnatatggtggtaggcaagagagggtgtgcaggggaactgcccttataaaaccatcagatatcatgagtcttattcactatcacaaaaacagcatgggaaaaacccaccctcatgaatcaattacaacccagttggtccctcccgtgataggtggggattacaggagctacaattcaagatgagattcagttggggacacagccaaaccatatcagaccacatgtcaaaagtgaacgactctaggtaaagggtatatgcttgcttttagtactatttttgtagcttgtctgcaaatctgaaaatatatttaaaaataaacatatgagctcat

SEQ ID NO: 1145 - DNA, 661 bp, Homo sapiens
  misc_feature [331]..[331]: Chromosome 8, SNP identification no. = rs6577790
  misc_feature [331]..[331]: allele = g, g, in linkage disequilibrium with rs1399176, rs10505685, respectively
  misc_feature [331]..[331]: n is a, t, c or g
ttaaagtgcaggctcatttcttctgctaattagttgaaggatgatcttccttgccaaggggccgaatgacaggagattcatttcttcaatttaaatctgtttttaaatgtctttctgaagcctttaggctttggaatttgaattctataaaattcaatgctggggattatctctttttcttttatacttaaaccctaagcaaggttcaatagagatccaagcattatagagcacccagtggtcattgagtccacacacttagtcagcaaaacagtccgcgtggtaattttaatcatcactccatcactcttgagagactggcctaacttcntatattatgatagattttttgaaactgtgacttattcattaaatgttcgattctttgaaatacttagcttggcactgaattgataaatttgatttcccagcactgcagctgtaatcatcctgtgtgtttaaatctgctcctattcaagggtcagtagtatggctggggaggcatagtcccaactggttttgaaaataattctcacagtcccccaaggtggtgactgcaatttggattttgtttcatattgcgatgacaatgtaatcattacactattacagaaattaaagaattgtggcatatattaggttggtgggaaaaattgcagtt

SEQ ID NO: 1146 - DNA, 661 bp, Homo sapiens
  misc_feature [331]..[331]: Chromosome 8, SNP identification no. = rs4909665
  misc_feature [331]..[331]: allele = g, g, in linkage disequilibrium with rs1399176, rs10505685, respectively
  misc_feature [331]..[331]: n is a, t, c or g
catgtgagtaataagtgctaagcattcaagctggcctcaccttccttctatttccttgctattatcttagaacccttctaatgtttctcctataatagtattccaagaactgtacctgcaaaaagggatctatgacctctataataattttgaattgtaatatactgatgagctaaaaaaaaatccaagcatttttttctttcatttatttgtcaagcatttattgaaatcactcttctaggctctgagaggaaaaactgccctagtggagttttatttgtttgttaaatgataactgaatttatagttcttggctcactttttaagacanttttaagaccaattttgggttcacagcaaaattaagagaaatatagagagatttcccatatactctctctccctacacttttacagactcttcaattaccaacatccctcaccagagtggtacattttttacagttgatgagcctacactaacacatcatgatcacccaacgtctttagtttacattagggctcatgattactgttgtatattctgtgggtttcgacaaatgtgtaaggacatgtacacatcgttataatagcaaaagagtattttcactgctctaaaaatcctctgtgctcttcgtattcatccttccctcccctcaaa

SEQ ID NO: 1147 - DNA, 661 bp, Homo sapiens
  misc_feature [331]..[331]: Chromosome 8, SNP identification no. = rs6577792
  misc_feature [331]..[331]: allele = g, g, in linkage disequilibrium with rs1399176, rs10505685, respectively
  misc_feature [331]..[331]: n is a, t, c or g
attggcctagctgggtacaatggctcaggcctgtaatcccagcactttgggaggctgaggcgggcagatcaaaaggtcaggagttcaagagcagcctgaccaacgtggtgaaaccctgtctctaataaaaattcaaaaattagcagggcatggtggcacatgcctgtaatcccagctatttgggaggctgaggcaggagaatcacttgaacctgggaagcagagtttgcagtgagctaaaatggcgccattgcactctagcctgggcaacagagtgagacttcatctcaaaaaaataaaacaaaaataaaaaaagaaagaaatggcctatntaatctaggttataaaatttgtgggcatattatggttcatagtattctttctttgtaattattttattttcttaagttccagggtacgtgtgcagaatgttcaggtttgtttcataggtaagtgtgtgccatggtggtttgctgcacctgtcaacccatcaactaggtattaagcccagcatgcattagctcttttccctaatgctctccttcttccaaccatcccctgacaggccccagtaagtgttgttcccctccctgtgtccaggtgttctcattgttcaactcccacttataagtgagaacacacagtgtttggttttctattcc

SEQ ID NO: 1148 - DNA, 661 bp, Homo sapiens
  misc_feature [331]..[331]: Chromosome 8, SNP identification no. = rs4582597
  misc_feature [331]..[331]: allele = g, g, in linkage disequilibrium with rs1399176, rs10505685, respectively
  misc_feature [331]..[331]: n is a, t, c or g
aaaaaaaaaagtaaacgttataaagatgggaaacacaaaaataaacttgttttaaaaatttttggaggacatgtttgtgtacataaaaaatcttaagcaacctacaccaaaccactgctataaggaataactgaatctaaaaacctagcaggatataaaaccaattatacagaaatctattttattttcataaactttttatgacaactaaaaaattaagtgaaaaacattatttacaatagcatcaaaatgacataatgaagaatagaacatttgaaaagaagctggcagaaaggggctgattagatgcatccaggaccaacatctgccnccaagggaccaggacactaggaagacgggtgcactctgagcagatctttgcaaggaagggattgagagtggacagagggaggacaaagatgctgggctcaaagggtaggaagctgggtaaactgcatgggccttacatgaagcaggactcattcctggaccctagtgactcctatgatagggatgagttgaagagacaaagagcaatgcactcttaccatggacgcctggaatactgggagcaggagacccatgacccccacagacacttgaactagtagacacagctgcttagagaggtgctaggggcaggacttctgcttgtgcagag

SEQ ID NO: 1149 - DNA, 661 bp, Homo sapiens
  misc_feature [331]..[331]: Chromosome 8, SNP identification no. = rs10098545
  misc_feature [331]..[331]: allele = g, g, in linkage disequilibrium with rs1399176, rs10505685, respectively
  misc_feature [331]..[331]: n is a, t, c or g
taggggcctgcatcgtagttcttacactggcaggcaatgcttgactatatcagagagttccagtacagcagcctccaccaacgtgcaccagcctatctccctcaactgcatctccctcaactgggatctccctcaactgcaatctctcttgtgccaatttgccagcacacccacactcacctaaggctacctcccaccatagttttgccaataagtgtgtgcacaagcaaacctcacctccccttccctgctcgagcaggggtgtatgtgcaccttattgtgccattgttattggtgtctgtgcacccaaccttgcctgcacttcacgttngctgttgctgctggtacaagtgaataagaatggattccgctgctaccacccaatgaagcatgttggctggcaccaccttttggagtgtggtggcctccagccagggaacactttgggccctctagggcagcagttttccaacttcaaggggccaaagaacaaagcttggcttcacataccagctccccagtgttagagaatgaagcccaggagtgctgagctaagccatggtccccctcaaatttaccagaaatgtaggcctttgattgaacccaccttataccacaatcaaactcctagggatatcaaagaagctaaaagaaaaaaaaa

SEQ ID NO: 1150 - DNA, 661 bp, Homo sapiens
  misc_feature [331]..[331]: Chromosome 8, SNP identification no. = rs2943199
  misc_feature [331]..[331]: allele = c, c, in linkage disequilibrium with rs1399176, rs10505685, respectively
  misc_feature [331]..[331]: n is a, t, c or g
cctttcaaactgagagatcaaagtatattcataatggacttagacctaggaaatgcaaggggcagtgagaagatagaagtgactatggccatacatagcaggttggaactgcactcccatgagttaatggacacagattcatgagtcttgttaatttcatgtgtgtagggggtgggggcacatacacatgcatgagatatacaacctgggttgaaacctacatcagttgcaacaataattggggcttgaattgggagttttaagcagccaatagcttttgcatcattgaggataaaaaatccccagcaatgtgagtctccaaggataccanaaaaatggtgcattagaaaaaagtgtaaactttgactgcttccctaagccagagaggattttattaatcaccccttgtgggcgttagaatttaattccagcttcaatagaatgagatttatctcactttcttacccttcctcccaccctcagcttttattctgtagaagatgcagttaagagtttcctctcctactgcaggctgatttctttcagctgactatggctggggaagaaaagaatcgaggattgtgtatgaagttcagagtttgaatgagacccaggtcatgacatattagtaacagaactaagaccattcttgtgataaaag

SEQ ID NO: 1151 - DNA, 661 bp, Homo sapiens
  misc_feature [331]..[331]: Chromosome 8, SNP identification no. = rs2960100
  misc_feature [331]..[331]: allele = t, t, in linkage disequilibrium with rs1399176, rs10505685, respectively
  misc_feature [331]..[331]: n is a, t, c or g
gggaatgaaaaaaagactactgtacatacattagagtctgaataataggagttgtgatagtgtcataaattgaacaagagaggggattaggcaggcaaggaagataaatccaacttcagacacaatgtatttgagaaactgtagaacacccagtttgtaagtttcatcagaaagttaaaagcgcaaggggaaaatgttagagcgataaagaaatgtgggagtcagtttatagagactaattttagtaggatcctcctgtgaatcttttaaattggaagatctgagtactatcatctgctcacttgagcacaggacagttttgtagtgttgngaatagcacaattcaacatcttacaaaggcatttaaattctggcagaaacttaggggttgaagagagtaaagtatttctagagcaactcataaacacaacatctatttttctaaacataatgcatgccagctgtaatgtaacctcataatctaaggttcttcctatgcccaattatagctgggtaattcctcctgagtgaatggcaaagaaagtgttgtatctttttttaacaaattctaattaatacttcttatatatcatgctacttgcattcaaatttttgagacacacacacacacacacaaacatatatatatttacacatatag

SEQ ID NO: 1152 - DNA, 661 bp, Homo sapiens
  misc_feature [331]..[331]: Chromosome 8, SNP identification no. = rs11166725
  misc_feature [331]..[331]: allele = g, g, in linkage disequilibrium with rs1399176, rs10505685, respectively
  misc_feature [331]..[331]: n is a, t, c or g
gggtgcatatattagtggctaaggacagacactaaataaatagtgttttttgatgcccagtgtctcagtgaatggttatttgctatggagaaaagcagatgagaaaaggaggtaggaacaattgcaggaaggtgtctaaattaccctagggtagctagggaaagacccactgagaaggtgccttttgagctcaaaactgatggaggtgaggaagtgacccatgtacatctggaggaagatgtacattcctattagatgtacattagctgtatatttctattcctcctgacaggaggaatagaaagtgaaaaaaaattcctgcagtgaaacnttcctggaaattttatgaaaaacttaaaagaggccagcgcagctggagcaatgtacaatgaggcaaagatggaggagacaaagcaaagaatgtaagaaagatatttagggtcttggtgatgctgatgcagaccagaagcctttggtgggcttgagcagcagagttccatgatgcctcttcttctttttaatcactctcattctgaatttcagaatagattttgtgtcctgttgtcaatgaccttgtgcagaagtgaaaattgatgatgccgaaagaaagagagaagagttggaggggcagcacccttcacccggtagcaggaacatgatt

SEQ ID NO: 1153 - DNA, 661 bp, Homo sapiens
  misc_feature [331]..[331]: Chromosome 8, SNP identification no. = rs17629911
  misc_feature [331]..[331]: allele = g, g, in linkage disequilibrium with rs1399176, rs10505685, respectively
  misc_feature [331]..[331]: n is a, t, c or g
taggaattcaacttagactttctttaatttctcgtggttccattaaaatttttgcaaaaaaaaaataagctttgacattcctacttcctgcatgggtaagtttgcattttttattgatggttcatccatctctaattttgttagatggagattgcataggcgttgtaaggaaaatgaagcagagaattcctgtcatgtaattatattttaaaagccaagtaatagtggctacttttgttagcattagcaattattggaccttttaacttcagctgtgataaagaaatcccttgtaatgagcttgcagtggtagttttacatacctgtcatnttaacgtgaataatagaattaatgtcaaggggaattgatgcaggcattatttatttaaaaatacacaggagaaaggaaaacataatttggtaggtaatcacataaatgccagctgaggctcttagttcaatactctggattcttagtactccaaataaattttttgattgattgaaaatacatttcttaaagataagagtcatgtcttatgctcagaatcacaaaattttcaagttgaaaaggagcctagaaattatctcagcagccacaaatactgaagccttgggggttaagcagatatcacaaatgagtgaaaactacagacagggg

SEQ ID NO: 1154 - DNA, 661 bp, Homo sapiens
  misc_feature [331]..[331]: Chromosome 8, SNP identification no. = rs10505682
  misc_feature [331]..[331]: allele = c, c, in linkage disequilibrium with rs1399176, rs10505685, respectively
  misc_feature [331]..[331]: n is a, t, c or g
cagagaagcagagaaaaatgcctttaaacatgaaaagagcatatcaacacaaaattctaaacacagacactatattcaactgattaaaactatgaagtttgggaaataccatttttttctttattttgtgaaggatattttgtgtcttttgtggcctaatccctgggttgttgtcagcacatgggacaggtctctaaggagagagtacagactcttctcttttatcaaaccttcactttctgtcttccccaagaggaatagatacaagtgtggtctgtcagattaaaagtactgatttggccacatgtagagttactggagtttcagtaancgaaaaggtgacacatgtaaataagccttttcttcttccttttccaagattattttttgtcctgcacctcagctgaaaaagtagtgtgtagtctcaagacctgccttctgaacaactgagcactcaactcctccttcctttcttccatgttgccagagagaggagagtacattctgaaactgttgggttgatggcagagttcagatatcccttctgaatctcccgttgagatataatccccagtgttggaggtagggcctggtgggaggtatattggtcatgagagaggatccctcatggcttggtgctgtcctagcgatggtgagtgaa

SEQ ID NO: 1155 - DNA, 661 bp, Homo sapiens
  misc_feature [331]..[331]: Chromosome 8, SNP identification no. = rs17632067
  misc_feature [331]..[331]: allele = g, g, in linkage disequilibrium with rs1399176, rs10505685, respectively
  misc_feature [331]..[331]: n is a, t, c or g
aaagaaaagaaaagaaaatgggattagaaataggatgactgtggtctaagcatcgtaaagctgtctgtcttctggttttctttttccgtattcacacagccttatcagaacccctgtgagattgtacaaaatgctggccttatttccactaacagttgttggttttgttgttttcatccaaataccttagtcataagtaattggatttccttactacagaagaactggcatttttgtgataatgaagttgagaacaggggttcatttgacattaaaggtgctttgcaaatgtactataaaaacctggtttagaagagtacattaaggaatngagtgagggtttaatcttcaagaaatgtactgaaatatccagaggatactaggcaatggcatgtgaataagctcttaaagcatccctgcgttacctgaaactcaggtctgtttcttaagtgtggcccttgttttaaattgcagattcatttcccatattctttaagtcttccagaaaagtggcaaggccactgtcaaaaacaaacaaataaaaaacccaggaaacaaaaactgaaaaaatacaaaattggaatatgattgttttcaaaggcaagaaaaagactcatcagctagaaggaagaagatccatacagacacaaaggtagaaaaa

SEQ ID NO: 1156 - DNA, 661 bp, Homo sapiens
  misc_feature [331]..[331]: Chromosome 8, SNP identification no. = rs11786383
  misc_feature [331]..[331]: allele = t, t, in linkage disequilibrium with rs1399176, rs10505685, respectively
  misc_feature [331]..[331]: n is a, t, c or g
tgatccacttaaaaacaaaatatgttttaaaagtatgttaatgaacaaataattctttgaaaatgaattaattcaattatagattcactcactccatctttcataatgacttgggcagtttaattgccagcattttaatttccaattgtttcctgctactctataagaatggaattaattttgaattagtagccttgtgtatctaaattcatgaataatgttgagtaggcttttggtttcttgttttgtttcatttttattttcttttaatttttgattccttgggattttctacataaacaatcatatcatctcttctgcaaataaaganaattttgcttcttcctttaaaatttttaagccttttctttatcttaactcattgaaatccaccaatgcaaggctgaatagaagaggttttttttttcccaaaacaagaggaaacaattcagttgccttatttttgaaatcagagagaaacaattgtctctcactgtaacgtttgctgtcaattttccatttgtgcttttttaaaatttgaggaagttccttactatttttactttaggtgagtgttaaattctgtctaatgttctttatgtacctatttaaaagaaccttttattcccggaacgtggtaaattttattgactgaattttt

SEQ ID NO: 1157 - DNA, 661 bp, Homo sapiens
  misc_feature [331]..[331]: Chromosome 8, SNP identification no. = rs11773949
  misc_feature [331]..[331]: allele = a, a, in linkage disequilibrium with rs1399176, rs10505685, respectively
  misc_feature [331]..[331]: n is a, t, c or g
agtagttgggaccacaggcatacaccaccatgcctggctaatttttgtattttttgtagagacagggtttcgctacgttaaccaggctggtctcaaactcctgggctcaagcaatctgcctgcctcggcctcccatactgcttggattacaggcataagccaccatacctggcctattttttgtatataaataattttgaattttaacatgggtattgtgaatgttatctcgtgaggatgctaggtagtattataatcatatagaggatgataatgttttgttctagcaggcaatcagcccagataggttcagattgtgaattccatctcntcttctttttgtgatggctcaaatctcaatcatatctctaactctactatgttactttgggtctgatttatgcctgcatagctcagggaatggtgtgagacacacgtgtttacttttgattttacttctgttctctaagcttttggtacattggtttgggtgtcttccctgcatatgtaatcctggagtaagttggagactgagcagcagtccaaatctcagttcagcttgccaaacctctgttatactggtttgggtctctctcacacatgcatagctcagaaataagtctgcaattttggttcatttatagatttagcagacgtatgt

SEQ ID NO: 1158 - DNA, 661 bp, Homo sapiens
  misc_feature [331]..[331]: Chromosome 8, SNP identification no. = rs1399176
  misc_feature [331]..[331]: allele = c, in linkage disequilibrium with rs10505685, respectively
  misc_feature [331]..[331]: n is a, t, c or g
tttcaaatagttctttttgtctagttctgttatgaacatggaattttgaatctgcagaaagcaaatttgagactcatttaaaatttaataaataaccataatatattaaaagtcaaattataatagtgtgatgttattgaattagggcaaatacatgacactgtgaaatccttaataaattatgcatgaggcattctgaattgtttacctcaatttggacaattttagagattaaagagtactgtgtaatttagtttgtagttttagggcataatggggagaagagaaacatagcttgtatttgttccagcttatttttgtattagtgtcntacttcacaattgtgtttgaaaacatttatttatttactttacattaatattgcttatcgttcaatgttttcagaagtaaatcaacttcaatagaagttaaaaatgaaagcttcttttggaaataaatgtggttactctcacaaatcttatctatctcttgactctttgtaagacaattgtctactcatacatttattttcaaaatcatctacttcaagctttaacatcagagcaaaatgtttcttgctcatgaaacaatgagaaatagtagagtgtgtgtgtgtgtgtgtgtgtgtgtgtgtgtgtgcgaattttccctggaggaagag

SEQ ID NO: 1159 - DNA, 661 bp, Homo sapiens
  misc_feature [331]..[331]: Chromosome 8, SNP identification no. = rs10505684
  misc_feature [331]..[331]: allele = g, g, in linkage disequilibrium with rs1399176, rs10505685, respectively
  misc_feature [331]..[331]: n is a, t, c or g
ggaggctgaggcaggagaatcgcttgaacccaggaggcggaggttgcagtgagctgagatcgcaccactgcactccagcctgggtgacagagtgaggttctgtcccaaaaaaaaaaaaaaagaaagaaaaaggaaaaggatgatgatcaataagttaatctacagtatgtattgagaacttaatttataaaacaaaatatcaaagaatggaaggtattgggaaatagaataagacagtaataagaaaaaaaaaacaaaaaaagaatcagatggtgaaatgtggcttcactctttattatctttgttttctcagaaaatttatttaactcantttcttcacttaaacaataaaagacttaataatctagacttaaaaaaatagttttaacacttaaagttcctgacacatagcagaggtttgatagttgttagttccccaaacatagcactgagaagcaaatctatatttgactccaaatttcagtcttttaaccaggatgcaaaattcatgcacttgatgagcccatcattattgatagggccagcctcattcatgtttttttttttttttttttttttttgagacagatctcactctgtcgcccaggctggagtgcagtggtgtgatctcggctcgctgcaacctccccatccctggttc

SEQ ID NO: 1160 - DNA, 661 bp, Homo sapiens
  misc_feature [331]..[331]: Chromosome 8, SNP identification no. = rs7816962
  misc_feature [331]..[331]: allele = c, c, in linkage disequilibrium with rs1399176, rs10505685, respectively
  misc_feature [331]..[331]: n is a, t, c or g
ctacagtatgtattgagaacttaatttataaaacaaaatatcaaagaatggaaggtattgggaaatagaataagacagtaataagaaaaaaaaaacaaaaaaagaatcagatggtgaaatgtggcttcactctttattatctttgttttctcagaaaatttatttaactcaatttcttcacttaaacaataaaagacttaataatctagacttaaaaaaatagttttaacacttaaagttcctgacacatagcagaggtttgatagttgttagttccccaaacatagcactgagaagcaaatctatatttgactccaaatttcagtctttnaaccaggatgcaaaattcatgcacttgatgagcccatcattattgatagggccagcctcattcatgtttttttttttttttttttttttttgagacagatctcactctgtcgcccaggctggagtgcagtggtgtgatctcggctcgctgcaacctccccatccctggttcaagcaattctcctgctttggtctcccaagtagctgggattacaggcacccaccaccacgcccagctaatttttgtatttttagtagagatggggtttcattatgttggccaggctggtctcaaatttctgacctcaggtgatcagcccacctcggcctc

SEQ ID NO: 1161 - DNA, 661 bp, Homo sapiens
  misc_feature [331]..[331]: Chromosome 8, SNP identification no. = rs6577803
  misc_feature [331]..[331]: allele = c, c, in linkage disequilibrium with rs1399176, rs10505685, respectively
  misc_feature [331]..[331]: n is a, t, c or g
gtagctgggattacaggcacccaccaccacgcccagctaatttttgtatttttagtagagatggggtttcattatgttggccaggctggtctcaaatttctgacctcaggtgatcagcccacctcggcctcccaatgtgctgagattacaggcatgagccaccgcgcctgccccagcctcattcttgtaatggatatgtttatcaatgtaataaaatgtcagtggtttaatacaaaatttaaaaaatcctgtggtggtgcattctacttctgcactcattttcaaacccattttcagcacgtagattgtgccattttcagcacaaagctcnatctcagttttatggtacaaaactatctcaaggaggctgttaagtgtagtctacctgtgtgcttagggaggaggagaaaaacacgcatatggataagtagtagcagtctctgcaatacccagtcccttccatttgaagctttggtgataccctagactcctcatttggcagagccaatactgtacgctcatcaaattatttccttttgtcctcaacaaataggaagacaacatttgccagaactcttgcattttcatgggatagtatgaggaggtctggccaatgtgcatggacaggcaggatgcacaccacagaactctccaggaaatt

SEQ ID NO: 1162 - DNA, 661 bp, Homo sapiens
  misc_feature [331]..[331]: Chromosome 8, SNP identification no. = rs6996799
  misc_feature [331]..[331]: allele = g, g, in linkage disequilibrium with rs1399176, rs10505685, respectively
  misc_feature [331]..[331]: n is a, t, c or g
tttttctttgagaaagaccagagtctaatgaatgaatttccccagggcacaggaaaactgtaccattccattgtctttccacaaggtactttagagattccacggaacatcaagtactatatatatcaactacatcaactactatatgtttcctattttccctaatttgaacgcaagtgccaactatggggttccttttggggttctgccatcatgtatcaagtagcagtctggaggcgaacaacttgtattattctgttcataggttgagaaccaggaaagtcatatccaaatctgatacagggcactgcatttcaccaggagatcctgnacttatgattggatgaattcactgaatgagatttgaggttgtaactcttgaagaggaagtaaagagttctataggagggaggaaaatgaaacagaaggatagatcatataatttctttcttccgtgttcccctcatgctattttcttcacgagaaaaccttcttccccaaatttctgaccaaacccctctaagttttttcagttaagactaaataaccatcccttccatagagcattttcccctacaacaggaaaatgttatctgtccttccactagaagcccacgacagtctatctgtatctttttacagctcattgacatcaagatta

SEQ ID NO: 1163 - DNA, 661 bp, Homo sapiens
  misc_feature [331]..[331]: Chromosome 8, SNP identification no. = rs17683816
  misc_feature [331]..[331]: allele = c, c, in linkage disequilibrium with rs1399176, rs10505685, respectively
  misc_feature [331]..[331]: n is a, t, c or g
atggatgcatgtatagaaatatacatgcaggcattaaagagatttctcccataccctgtggaatggcacagtcatggagatgtcaggggggccacttctggtgtactgcaatctcctgtccacctccacctgggcctccaacccaacacacacacacacgcacacacacacaaatcagaacatttctctacatttatgcctcgcaacttgtgtctgtaacagtagagcaggagagattttgtagtgagatggattcagaaataaaatggaggcagattaggatagtgtaacctcagttttctatcacattctggtgacctgggtaacatgnaccagccagtggaagtcagaagctattgcaaatattcaagagatattttcagaggctctaggcatttgctaaattgttcacgccaggaggatcaaatgaggcatttagtaaaccagaaaatagttctccatccttcagcagggaattcagacaggggttgcaaccctgtagaaaggaaacttaggagcaggcacgtaccagtccaggcagtgggagtggtctgtcctgaggggctggccatgggttgttcattgtctgcggaaatgtagaaacaatgacactgacccagtgtcagtctgttcattacaattacagtgtatcagactttct

SEQ ID NO: 1164 - DNA, 661 bp, Homo sapiens
  misc_feature [331]..[331]: Chromosome 8, SNP identification no. = rs12677749
  misc_feature [331]..[331]: allele = a, a, in linkage disequilibrium with rs1399176, rs10505685, respectively
  misc_feature [331]..[331]: n is a, t, c or g
ggtctgtcctgaggggctggccatgggttgttcattgtctgcggaaatgtagaaacaatgacactgacccagtgtcagtctgttcattacaattacagtgtatcagactttctaaacaccatcagtgataaagcactctcaaaacaaaacaaaacaaaacaaaaataaaactacatattttcttcaaattttacacaactgctgctgctgttgttgctttggaagtacacatacacagtcacaacacagatttgcttcaaattagtgcatttttcaaattacttttctttaaataaacatgatattctctaaggaggttaaattcttaganatcttggagagtcaggtcctgatatacatggactgagatacacataagggattcaagagtgagtttgtgaagattcaaaatcattgagcttgctctgggcgtacttcatgttccatcccatgtgtcacatgacagcagaggattcaaggtgaagttaatagcacagagattgcaaagaaaaagacaaagaaatgagataatgagaaatgctatcttttttttttttttttttttttttttgtgacagagcctcgctctgttgcccagactggatgcaaccttggctcactgcaacctctgcctccagggttcaagcgaatctcctgcctc

SEQ ID NO: 1165 - DNA, 661 bp, Homo sapiens
  misc_feature [331]..[331]: Chromosome 8, SNP identification no. = rs6981747
  misc_feature [331]..[331]: allele = t, t, in linkage disequilibrium with rs1399176, rs10505685, respectively
  misc_feature [331]..[331]: n is a, t, c or g
gacttaggtccagcaatgaactcaacagaccatgtacttgctttcttgggatggagatacacacacacacacacaaacacacacacaccctgatacggtttggctgtgtccccatccaaatctcatcttgaattgtagttcccacaattcccacgtgttgtgggagggactcagtgatctgatggttttataagaggaaaccccttttttctcattctgtcttgcctgatgccatgtaagacgtgccttttgccttccactatgactgtgaggcctccccagccccatggaaatgtgagctcttgaaacctctttttctttataaaacacncagtctcaggtatgtctttatcaacagcttgaaaacagactaacacaccccaatacatatatgttgtagtctcatttatcaattgtgaagaaaagaacaggataaaaggacatagatgatggggatgggagttgtctctggagttggcaggtcagcggacacctcaatgaagttaaaagcagctgtcatatagacatccgggggaagagtgtttcaggcagagcaggcatcatggagaaaagtggggatgtgctctctgtattcaaggaagaataacaggccaaggatatctacagcgaaagaagcaaggaagtcataaaaaaaaaaaag

SEQ ID NO: 1166 - DNA, 661 bp, Homo sapiens
  misc_feature [331]..[331]: Chromosome 8, SNP identification no. = rs6998164
  misc_feature [331]..[331]: allele = t, t, in linkage disequilibrium with rs1399176, rs10505685, respectively
  misc_feature [331]..[331]: n is a, t, c or g
tttccaatttatgtataatatttatattgctttaatagcaatattggaaacctaaaatatgaagtttatttaacaattagaggagttattttaaatgttgcccttcatcgatggtcagaacatggactttgatgccagataaacatgtgtttgtttcttggaccaaattcataataggcataaaaccttagttactttatatttacagatttcaattttgatacccactaacttagaataattgaacttactttgtggacagtaagttgtgaagaagaaactaaaaatgtatgtaaagttcccagcacaatctggtatttgtgttataganagaataattggcggccatttgtatccacttacatattattggatttaacctgaaattttctctagttttgtgatagtagtaattgcaaaattttttaagaattataagcactctatatgcaatgtatgaccccataaatgtaggcaatcattatcatgagagagagaagagatggaagccagaccaggtacaagaaaatggtttctagtctttctccaggagtgtaataaattatgagatcaactacaacaaaaaataatattcttgtgggagtttacaaaaggttaatatttctaagtaaagaaagtttttgtggcatttcaccagtaa

SEQ ID NO: 1167 - DNA, 661 bp, Homo sapiens
  misc_feature [331]..[331]: Chromosome 8, SNP identification no. = rs4384013
  misc_feature [331]..[331]: allele = g, g, in linkage disequilibrium with rs1399176, rs10505685, respectively
  misc_feature [331]..[331]: n is a, t, c or g
atgttcgctgttaagtttgcagatggaggattctacatagccagcagggattgaatagcgcatgcgataaatgcaccctaaacgtctttctttggtacttccttttaactccgcaaaataagatagcactagtaggaaagaaaccaaggaatctgcttggtaagtttttaaagtaaagagaaaaacatgttttagaggtgaatacatggcacatcagatgggacataggacgaaatctctccacagcaatgaagaattcactgagtctatatgccctcgtggaaagagacagtggaagagctgaatgcccggtagagtatgcgtgaattgnagaaccaagccacttccatcaccttttatcacagacatgacttagcaaaggcctggtatccaggtccctctcacctctctgggtcttggccctatgccctctgctgtttttctttccacctccttttctgtctccgaaactctaagtcattttacagcttgttggcttgtgaccttaatctgacctgcaatttttggattgcttttaaattgaatgtaaatgtttttagttactaatatgctctctccagtaaaacagtcgatattacatgctttacttctgctttatacacgttcttaacttcctgatggctattatgagtctgtgtgc

SEQ ID NO: 1168 - DNA, 661 bp, Homo sapiens
  misc_feature [331]..[331]: Chromosome 8, SNP identification no. = rs4625065
  misc_feature [331]..[331]: allele = g, g, in linkage disequilibrium with rs1399176, rs10505685, respectively
  misc_feature [331]..[331]: n is a, t, c or g
aagagaaaaacatgttttagaggtgaatacatggcacatcagatgggacataggacgaaatctctccacagcaatgaagaattcactgagtctatatgccctcgtggaaagagacagtggaagagctgaatgcccggtagagtatgcgtgaattgaagaaccaagccacttccatcaccttttatcacagacatgacttagcaaaggcctggtatccaggtccctctcacctctctgggtcttggccctatgccctctgctgtttttctttccacctccttttctgtctccgaaactctaagtcattttacagcttgttggcttgtgaccntaatctgacctgcaatttttggattgcttttaaattgaatgtaaatgtttttagttactaatatgctctctccagtaaaacagtcgatattacatgctttacttctgctttatacacgttcttaacttcctgatggctattatgagtctgtgtgcctaccagtgagcctcccttcacttcacccaggaaacctttcctctccaccctgtgatggtgaatactgagtgtcaacttgattggattgaaggatgcaacgcattgttcctgggtgtgtctttgaggttgttgccaaaagagattaacatatgagtcagtgaactcagagaggca

SEQ ID NO: 1169 - DNA, 661 bp, Homo sapiens
  misc_feature [331]..[331]: Chromosome 8, SNP identification no. = rs11786764
  misc_feature [331]..[331]: allele = a, a, in linkage disequilibrium with rs1399176, rs10505685, respectively
  misc_feature [331]..[331]: n is a, t, c or g
catggccatttgagatccctcttcaaaagtacaaacttccctttgaggccatgtggtttgatgctctcataactgcaagtccctggcactctatcaggaagagatttattaaatgtaacagaccagaatattattacataaagaacattgtcccttagctgtaatcaaattacccagccatctgatggtttccctcatttcctgagcagtttatattttctatcactgctacttggtgagaaccagatttgtgtctgtccaccgtgctggacacagccacattggaaattatatctccaatatcgattgaatagaaatatcagaagactcngtaccaggtggttttttagtttgttggatatttactgttattttgctgcttatttttcggcgccaatttctctttggtgttccaacaaaagttaaagtagccagttaatcacccttgatttttattccaccctattacttctagtttctgaacagtttttgaaaatcttttgaagtgttatgtccagtgatttacatagaagtagaaggctgtaaagttgatagttggctatcacggtgatggtatgacataagaacccagggatacctgatatgactcttcagccaaacatgactccacaggtgagtgaaacatgaagacactgagaca

SEQ ID NO: 1170 - DNA, 661 bp, Homo sapiens
  misc_feature [331]..[331]: Chromosome 8, SNP identification no. = rs11786786
  misc_feature [331]..[331]: allele = t, t, in linkage disequilibrium with rs1399176, rs10505685, respectively
  misc_feature [331]..[331]: n is a, t, c or g
tgatgctctcataactgcaagtccctggcactctatcaggaagagatttattaaatgtaacagaccagaatattattacataaagaacattgtcccttagctgtaatcaaattacccagccatctgatggtttccctcatttcctgagcagtttatattttctatcactgctacttggtgagaaccagatttgtgtctgtccaccgtgctggacacagccacattggaaattatatctccaatatcgattgaatagaaatatcagaagactccgtaccaggtggttttttagtttgttggatatttactgttattttgctgcttatttttnggcgccaatttctctttggtgttccaacaaaagttaaagtagccagttaatcacccttgatttttattccaccctattacttctagtttctgaacagtttttgaaaatcttttgaagtgttatgtccagtgatttacatagaagtagaaggctgtaaagttgatagttggctatcacggtgatggtatgacataagaacccagggatacctgatatgactcttcagccaaacatgactccacaggtgagtgaaacatgaagacactgagacatctgcaagttggaagcagcccaggtgacaattcactattaggtagggctttagacaca

SEQ ID NO: 1171 - DNA, 661 bp, Homo sapiens
  misc_feature [331]..[331]: Chromosome 8, SNP identification no. = rs11776612
  misc_feature [331]..[331]: allele = g, g, in linkage disequilibrium with rs1399176, rs10505685, respectively
  misc_feature [331]..[331]: n is a, t, c or g
ttaaatgtaacagaccagaatattattacataaagaacattgtcccttagctgtaatcaaattacccagccatctgatggtttccctcatttcctgagcagtttatattttctatcactgctacttggtgagaaccagatttgtgtctgtccaccgtgctggacacagccacattggaaattatatctccaatatcgattgaatagaaatatcagaagactccgtaccaggtggttttttagtttgttggatatttactgttattttgctgcttatttttcggcgccaatttctctttggtgttccaacaaaagttaaagtagccagttantcacccttgatttttattccaccctattacttctagtttctgaacagtttttgaaaatcttttgaagtgttatgtccagtgatttacatagaagtagaaggctgtaaagttgatagttggctatcacggtgatggtatgacataagaacccagggatacctgatatgactcttcagccaaacatgactccacaggtgagtgaaacatgaagacactgagacatctgcaagttggaagcagcccaggtgacaattcactattaggtagggctttagacacaactcccaatcaaacttgagtaagctgtcatggacacaaatgaattgcaag

SEQ ID NO: 1172 - DNA, 661 bp, Homo sapiens
  misc_feature [331]..[331]: Chromosome 8, SNP identification no. = rs1913453
  misc_feature [331]..[331]: allele = c, c, in linkage disequilibrium with rs1399176, rs10505685, respectively
  misc_feature [331]..[331]: n is a, t, c or g
ttcggaatgactattatatttgtcaactagttgagtatacaacatatacataatatatgtcataagagtgttatttcattcgatctccttttcttttaaaatgactcttgtcgtattccttctcttttatatacaggataggtaattcaccttcacctagtagcatatccagatgtaagaataatagaaatacaactcatcggaccccaccacttcctactcatccccaaccagaaaatatagtccccaccgtcctcatcgtctttcagacacatattcgtcagaacaagttaagttggggtacaacaagttcccagttgacatgtatcanattcagatgttcgtcctgtatgtatgtcttctataggtttataggtttaacggttcatttttgatttcgacaaagactcgatctgagagggatcctttatgttaagagattcagtttaatttggactttagtttcgaatttataaagtcttaagtatgtattaattccactatggaccatttgggagagtcgatctacttcctgaagggtcctagagtgcccacgacaatttatgaacggactgtgtggcctatatcgaaacctaatcacgtctctcgttttatacagaactgttgttgaatctcacaccgaaaaccactactccgattt

SEQ ID NO: 1173 - DNA, 661 bp, Homo sapiens
  misc_feature [331]..[331]: Chromosome 8, SNP identification no. = rs17684894
  misc_feature [331]..[331]: allele = c, c, in linkage disequilibrium with rs1399176, rs10505685, respectively
  misc_feature [331]..[331]: n is a, t, c or g
ttcctctagcttactttattgtgagaatactgtatataatacatatacaacatatgagttgatcaactgtttatattatcagtaaggcttccagtcaacagtaggctataagtagttaagtttgcaggaagctaaaagttgtacacaaattttaaactgcgtgggggattggttttccctcacctccacattgtttagggatctgcagtacctaggacaactagctgttatctatagcatactgagtacagatttgttcagttaaaccaaaagtttatttggtactttttttttaacctttcaaagtgctgtaggctatgtttctgccatntacttcggtactccatgaaagggatttccgtttacccagccagctccaaaagttacctcaatgttttcccagcctctggtgtttcctcgcttttcagcttctttctgccactctttatcaaagccaatgaaatatattatgttagttcccgagtcctagattccaacttctgtatcagttagctattactatttaacaaaaatctcaaaacctaattacttaaaattaccatttatttagctcgtgattctgtattttggaaaacgtctgggttcaacctttgctaaacttttggctttgctctcttttgtgtctgtggcttgtagtggg

SEQ ID NO: 1174 - DNA, 661 bp, Homo sapiens
  misc_feature [331]..[331]: Chromosome 8, SNP identification no. = rs17633888
  misc_feature [331]..[331]: allele = a, a, in linkage disequilibrium with rs1399176, rs10505685, respectively
  misc_feature [331]..[331]: n is a, t, c or g
gactttgttgaatgtttacataatgtaacaactaatcaaataatctgtcctataaacatttaagctttctaaagttgttcctaattacaaccctacttttgctgcactagaatcagattaaacaccataacaataatccaatgccttaagataaagtagtaggtgcattagcaagaaaaatgtggttgtgtttaatttagattcttcttgtaggctcatagcatattctagtataaaacatttacccttaagccttggaaactggctttatggatctaggcttttacatttagtggtatgtgtcaacaaggaaatcttgtattttccctcncatccaacatttgcaaatcagtggagaggtcacatttaataagccctacgttccaagttggaaaacaataaacaaaattaagttaaagttaccagatggtgggttaatagatgctgagtagcaaaaataacattggccactataattaacattttctcgtgccgaattatcctatctattaaaccatgtgataaccagtgctctcttttggtttaattattgccaagagggaccagggactctgtagacacttggattatacagcactgcagctgttgtagctggctccctgtagtgggtacaatagagtccctgctgagggctgatcct

SEQ ID NO: 1175 - DNA, 661 bp, Homo sapiens
  misc_feature [331]..[331]: Chromosome 8, SNP identification no. = rs17633935
  misc_feature [331]..[331]: allele = t, t, in linkage disequilibrium with rs1399176, rs10505685, respectively
  misc_feature [331]..[331]: n is a, t, c or g
tgcattagcaagaaaaatgtggttgtgtttaatttagattcttcttgtaggctcatagcatattctagtataaaacatttacccttaagccttggaaactggctttatggatctaggcttttacatttagtggtatgtgtcaacaaggaaatcttgtattttccctcgcatccaacatttgcaaatcagtggagaggtcacatttaataagccctacgttccaagttggaaaacaataaacaaaattaagttaaagttaccagatggtgggttaatagatgctgagtagcaaaaataacattggccactataattaacattttctcgtgcngaattatcctatctattaaaccatgtgataaccagtgctctcttttggtttaattattgccaagagggaccagggactctgtagacacttggattatacagcactgcagctgttgtagctggctccctgtagtgggtacaatagagtccctgctgagggctgatcctcccctggaggaatactgaaaaagacaaaaagacagtagttgtagaagaccaggagacagaactgttggagctctccattgaggaggtggctcaggaggcatgtggggctaaataaatcttggaaatggaaaaaactgggtttgttacagtaaagaatatttgt

SEQ ID NO: 1176 - DNA, 661 bp, Homo sapiens
  misc_feature [331]..[331]: Chromosome 8, SNP identification no. = rs17685141
  misc_feature [331]..[331]: allele = g, g, in linkage disequilibrium with rs1399176, rs10505685, respectively
  misc_feature [331]..[331]: n is a, t, c or g
aagaaaaatgtggttgtgtttaatttagattcttcttgtaggctcatagcatattctagtataaaacatttacccttaagccttggaaactggctttatggatctaggcttttacatttagtggtatgtgtcaacaaggaaatcttgtattttccctcgcatccaacatttgcaaatcagtggagaggtcacatttaataagccctacgttccaagttggaaaacaataaacaaaattaagttaaagttaccagatggtgggttaatagatgctgagtagcaaaaataacattggccactataattaacattttctcgtgccgaattatcntatctattaaaccatgtgataaccagtgctctcttttggtttaattattgccaagagggaccagggactctgtagacacttggattatacagcactgcagctgttgtagctggctccctgtagtgggtacaatagagtccctgctgagggctgatcctcccctggaggaatactgaaaaagacaaaaagacagtagttgtagaagaccaggagacagaactgttggagctctccattgaggaggtggctcaggaggcatgtggggctaaataaatcttggaaatggaaaaaactgggtttgttacagtaaagaatatttgttttaatttc

SEQ ID NO: 1177 - DNA, 661 bp, Homo sapiens
  misc_feature [331]..[331]: Chromosome 8, SNP identification no. = rs12677813
  misc_feature [331]..[331]: allele = a, a, in linkage disequilibrium with rs1399176, rs10505685, respectively
  misc_feature [331]..[331]: n is a, t, c or g
tcttttattgaaaggtgccatgtctattttctaataatttagcatgccaagtaccttgggatataccccaaacacactcaagaaatggttgttaacaggatgtatagtcctctcaagataaccattataaggaatgtaaccattaatatctgttgaacacttcctataggccagacattggtacctaagtagaagcccttaaatatttttgaatgaggtgaaacacaaaacaaagcaaatcaaataaataataatgtattgtcattatttgaccttcccgaagcctcttcagaagagctcctagcacagtgctgagctctagagccatttntgtttgtttggggcggggggatgcagatccccatgccacagccacaaggaaaggcagagggggctcagtagaggtacctgcagtgtgccatatgcacggaagtggtagtgagagtccgactgttgttgctgggggagaccatttcatgatggagaaatcaagcccagggagagtaaaagtcttcctgtgtcccagaactaattgatggcggagccaggatatgcccacatggtctaattcaagcctttatttagtgagtggtctccagagtggcaaggtcacattctatggatttacagattgatctattggggtgtcaaagtaaaatag

SEQ ID NO: 1178 - DNA, 661 bp, Homo sapiens
  misc_feature [331]..[331]: Chromosome 8, SNP identification no. = rs11780534
  misc_feature [331]..[331]: allele = t, t, in linkage disequilibrium with rs1399176, rs10505685, respectively
  misc_feature [331]..[331]: n is a, t, c or g
tcgccaccctcaaccgcattaaaacatcaggacattttataccgttctctcagctttctcaagggctccattagcatcgtgagaaacttaacactgaattggcaagtaattaaatgaagcatatgatgagcttccaaagccctgtttctttccggaggaaacccaagtgtctcacctgagttgaagtatccgaagacttctgtcatctggaaacattattcctggagcaagaaagatcatattctattgttgatgagggggataatagaaaatgtgcttatcgggaagaacaaagttatgttacctggcatggctgagcgttcacaatctnttgtaacagagctaagacaattcacttcctttcaagacactgtgaagcacttacaatgtgtcagatcctatagaaagtgaagaaataagccaaacttcctatcttgagggtctcatattctagcacaagagtcatataaacaaaaaaaaaaaaccctgtataatgctgtgtcataaattcaggaataaatcactacataaggtacgtaactgttccaatttcaaacgtgacctgcactttttctgacatgccccactgttctggcatacaaatgtcatcagaagactcagacactatcttacataattgcatcaagcaattcatctggtg

SEQ ID NO: 1179 - DNA, 661 bp, Homo sapiens
  misc_feature [331]..[331]: Chromosome 8, SNP identification no. = rs11777429
  misc_feature [331]..[331]: allele = g, g, in linkage disequilibrium with rs1399176, rs10505685, respectively
  misc_feature [331]..[331]: n is a, t, c or g
caaccgcattaaaacatcaggacattttataccgttctctcagctttctcaagggctccattagcatcgtgagaaacttaacactgaattggcaagtaattaaatgaagcatatgatgagcttccaaagccctgtttctttccggaggaaacccaagtgtctcacctgagttgaagtatccgaagacttctgtcatctggaaacattattcctggagcaagaaagatcatattctattgttgatgagggggataatagaaaatgtgcttatcgggaagaacaaagttatgttacctggcatggctgagcgttcacaatctgttgtaacagngctaagacaattcacttcctttcaagacactgtgaagcacttacaatgtgtcagatcctatagaaagtgaagaaataagccaaacttcctatcttgagggtctcatattctagcacaagagtcatataaacaaaaaaaaaaaaccctgtataatgctgtgtcataaattcaggaataaatcactacataaggtacgtaactgttccaatttcaaacgtgacctgcactttttctgacatgccccactgttctggcatacaaatgtcatcagaagactcagacactatcttacataattgcatcaagcaattcatctggtgtcttgtgggt

SEQ ID NO: 1180 - DNA, 661 bp, Homo sapiens
  misc_feature [331]..[331]: Chromosome 8, SNP identification no. = rs17634044
  misc_feature [331]..[331]: allele = g, g, in linkage disequilibrium with rs1399176, rs10505685, respectively
  misc_feature [331]..[331]: n is a, t, c or g
aagccaaacttcctatcttgagggtctcatattctagcacaagagtcatataaacaaaaaaaaaaaaccctgtataatgctgtgtcataaattcaggaataaatcactacataaggtacgtaactgttccaatttcaaacgtgacctgcactttttctgacatgccccactgttctggcatacaaatgtcatcagaagactcagacactatcttacataattgcatcaagcaattcatctggtgtcttgtgggttacaataaaaatatatacagaaaagaagagggaaaaatattataatagtatacgcttataatcatccttatcccatntctcctggaattaaccactgttagaatctaggcattgttattttcatcttaaatttaaaaagtatattttgtcataacatcatacatggttattaaaaattgaaaagcattaaaacaatgaaataaaccactgcaaacctcattacttaaaagtgacatcaggtgctaccgtaatgggtatctttcactaagcatgaacaaatacttaggggattggatatgctgaaggcatggaatattttataaagatggaattgtctttttcttctttagctactctttaatttgtgccctctttattgtctttttttttttttttgctaagtaatc

SEQ ID NO: 1181 - DNA, 661 bp, Homo sapiens
  misc_feature [331]..[331]: Chromosome 8, SNP identification no. = rs11166729
  misc_feature [331]..[331]: allele = g, g, in linkage disequilibrium with rs1399176, rs10505685, respectively
  misc_feature [331]..[331]: n is a, t, c or g
ttttactacattttgcttatttccttaagtattagatgaggggttcattttctaatacatgttccactcaagatagggtctactacatgttccactcaagatagggtctacttcatttgttcttaccagcttttccttgttatttttctaagcagtactttcgttttttctaagcaatactaatatctggctaggttgggataatagtttttatctgattacttttaaactcctttttttagttcatgtcattcattttttaatacggattggataactttgatttgttgagcaccatgccaacttctggtttttgttctccatgaggganagagatataaaacaaataaacatgcaaataaaattattccaaatatgtacaaaaagcacaagcatggtgctaaggaaataatcatgaagagatcttgtttatatttgaggggaagaaaatgcttctctgaagaagtgagaattgaaccaaaatctaaataatggtactcccaacactagaatagtgcctgtaatgtactagctgcttgataaatatttgatggtttgtaactcaaaggataaatgcttgacgggatggttaccccattctccatgatgagcttatttcacatggcattcctgtatccaaacatcttatatacacccataa

SEQ ID NO: 1182 - DNA, 661 bp, Homo sapiens
  misc_feature [331]..[331]: Chromosome 8, SNP identification no. = rs1514199
  misc_feature [331]..[331]: allele = a, a, in linkage disequilibrium with rs1399176, rs10505685, respectively
  misc_feature [331]..[331]: n is a, t, c or g
aattgaaccaaaatctaaataatggtactcccaacactagaatagtgcctgtaatgtactagctgcttgataaatatttgatggtttgtaactcaaaggataaatgcttgacgggatggttaccccattctccatgatgagcttatttcacatggcattcctgtatccaaacatcttatatacacccataaatatatacatccactatgaacccacaaaactttaaaaaatattaaaaaagaaaaaaataaatatttgataaatcagtgaatggataaataccttaatataagtattagaaagaagaacttttagggagagaggtctacangtgcccagaatattttactattctcatattcacttattaattctccttttagttttgacatcttttattactagaatgataatgatgataactactatctttatagctattatgtatgtattgacaccataaaacaggcactgaaactgtgcctggatctgtgtccccacccaattctcatgttgaattgtaaaccccagtgttggagatggggcctggtggaaggtgatttgatcatggaagtgttttctcatggtttaacaccattccccttggtactgtcatagtgatagtgagtcattgtgagatctggttgcttaaaactgtgta

SEQ ID NO: 1183 - DNA, 661 bp, Homo sapiens
  misc_feature [331]..[331]: Chromosome 8, SNP identification no. = rs1514200
  misc_feature [331]..[331]: allele = c, c, in linkage disequilibrium with rs1399176, rs10505685, respectively
  misc_feature [331]..[331]: n is a, t, c or g
gtgcctgtaatgtactagctgcttgataaatatttgatggtttgtaactcaaaggataaatgcttgacgggatggttaccccattctccatgatgagcttatttcacatggcattcctgtatccaaacatcttatatacacccataaatatatacatccactatgaacccacaaaactttaaaaaatattaaaaaagaaaaaaataaatatttgataaatcagtgaatggataaataccttaatataagtattagaaagaagaacttttagggagagaggtctacaggtgcccagaatattttactattctcatattcacttattaattcnccttttagttttgacatcttttattactagaatgataatgatgataactactatctttatagctattatgtatgtattgacaccataaaacaggcactgaaactgtgcctggatctgtgtccccacccaattctcatgttgaattgtaaaccccagtgttggagatggggcctggtggaaggtgatttgatcatggaagtgttttctcatggtttaacaccattccccttggtactgtcatagtgatagtgagtcattgtgagatctggttgcttaaaactgtgtaagacataagacatgcctgcttcttttttgcttttcaccatgatt

SEQ ID NO: 1184 - DNA, 661 bp, Homo sapiens
  misc_feature [331]..[331]: Chromosome 8, SNP identification no. = rs1514201
  misc_feature [331]..[331]: allele = c, c, in linkage disequilibrium with rs1399176, rs10505685, respectively
  misc_feature [331]..[331]: n is a, t, c or g
aatgcttgacgggatggttaccccattctccatgatgagcttatttcacatggcattcctgtatccaaacatcttatatacacccataaatatatacatccactatgaacccacaaaactttaaaaaatattaaaaaagaaaaaaataaatatttgataaatcagtgaatggataaataccttaatataagtattagaaagaagaacttttagggagagaggtctacaggtgcccagaatattttactattctcatattcacttattaattctccttttagttttgacatcttttattactagaatgataatgatgataactactatcttnatagctattatgtatgtattgacaccataaaacaggcactgaaactgtgcctggatctgtgtccccacccaattctcatgttgaattgtaaaccccagtgttggagatggggcctggtggaaggtgatttgatcatggaagtgttttctcatggtttaacaccattccccttggtactgtcatagtgatagtgagtcattgtgagatctggttgcttaaaactgtgtaagacataagacatgcctgcttcttttttgcttttcaccatgattataagtttcctgagacctccccagaatcagaagctgctgtgcttcctgtacagcccag

SEQ ID NO: 1185 - DNA, 661 bp, Homo sapiens
  misc_feature [331]..[331]: Chromosome 8, SNP identification no. = rs11780105
  misc_feature [331]..[331]: allele = g, g, in linkage disequilibrium with rs1399176, rs10505685, respectively
  misc_feature [331]..[331]: n is a, t, c or g
actgtgtaagacataagacatgcctgcttcttttttgcttttcaccatgattataagtttcctgagacctccccagaatcagaagctgctgtgcttcctgtacagcccagagaactgtgagccaatttaacctctttctttattaattacccagtctatgatatttctttatagcagtgtgaaaatggattaaactagcaaatttgtgccaaagagtggggcattgctataaagatacctgaaaatgtggaagtagcttgggaaatatgtaatgaatggaggttgaaacaatttggaagtttggactcagaagaagacaggaagataaggnaaggttggaacttcctagagatttgttgaatggttgtgaccaaaatgctggtagtgatatggataatgaagtccagggtgaggaggtctcagatggaaatgaggaacttattgggaactgttgtaaaggtcacttttgctatgctttagcaaagagcctgactgcatagtgcccctgctctaggggtctatggaaacttcaaattcagagtgatgatttggggtatctggtagaataaatttataagcagcaaagcattcatcctgtggcctagaggcttccaaccacctatacttatatacatgagcaaataaatgacctgaaggtgga

SEQ ID NO: 1186 - DNA, 661 bp, Homo sapiens
  misc_feature [331]..[331]: Chromosome 8, SNP identification no. = rs12375358
  misc_feature [331]..[331]: allele = c, c, in linkage disequilibrium with rs1399176, rs10505685, respectively
  misc_feature [331]..[331]: n is a, t, c or g
gggttttggacatgtgtggagcctctaatccctttcttctggcccacttctcctttctgtaactgggttatttacctaattcctatacctccattgtatgttgaaagtgactaacttgttttgatgttactggcttataggcaaaagggacttgctttgtctcagatgagactttggacatttcagttaatgctggaatgaggtaagactttggaggactgttggaaagacatgattgtattttgcaatgtgagaaagacatgatatttgggagagaccagggtggaattatgtggtttgaatctgcatccccacccaaatctcatgtcanattttattcctcagtgttggagatggggcctggtggaaggtgaatgaatcatgatggggcaggattctcatggtttcacacaccatcctccttggtgctgtcatggtgatagtgagttcccgtgagatctagttgtttaaaagtgtgtgacacctcctgtctctttcccttccacctgctccagccatgtaagacatctctgcttccccttcatcttctgtcttgattgtaagtttcctgaggcctcctcagaagcagaaacttctatgcttccattacaacctgtagaactgtgagtcgatgaaattgcttttctttataaattaccca

SEQ ID NO: 1187 - DNA, 661 bp, Homo sapiens
  misc_feature [331]..[331]: Chromosome 8, SNP identification no. = rs10505685
  misc_feature [331]..[331]: allele = c, in linkage disequilibrium with rs1399176, respectively
  misc_feature [331]..[331]: n is a, t, c or g
attctcatggtttcacacaccatcctccttggtgctgtcatggtgatagtgagttcccgtgagatctagttgtttaaaagtgtgtgacacctcctgtctctttcccttccacctgctccagccatgtaagacatctctgcttccccttcatcttctgtcttgattgtaagtttcctgaggcctcctcagaagcagaaacttctatgcttccattacaacctgtagaactgtgagtcgatgaaattgcttttctttataaattacccagtctcaggtgtttctttatagcagtacaggaatggactaatacaggcactctaatcactttcantgatatctcaattaaccatcagaaaattataaagtaaagctttgtatgtgtaagataatgttgcgttttgtttcgtttttccagatgaggaaattgcagcttaaagttgctaaacaaatttagccaaggccacaaagcaataggaaataacccaaaattgaaaacaggcttgcctttctgcaaatccaatgattgacatctccaagcctaatatgaggtcctgtgtggacaactgcttgtctcagcccaaatgccacaaaatataacaggtctgagtaatttatccacctatatcaaaggtgggtaaaagaattatgaaaaaaggtaaag

SEQ ID NO: 1188 - DNA, 661 bp, Homo sapiens
  misc_feature [331]..[331]: Chromosome 8, SNP identification no. = rs17685382
  misc_feature [331]..[331]: allele = t, t, in linkage disequilibrium with rs1399176, rs10505685, respectively
  misc_feature [331]..[331]: n is a, t, c or g
acttctatgcttccattacaacctgtagaactgtgagtcgatgaaattgcttttctttataaattacccagtctcaggtgtttctttatagcagtacaggaatggactaatacaggcactctaatcactttcattgatatctcaattaaccatcagaaaattataaagtaaagctttgtatgtgtaagataatgttgcgttttgtttcgtttttccagatgaggaaattgcagcttaaagttgctaaacaaatttagccaaggccacaaagcaataggaaataacccaaaattgaaaacaggcttgcctttctgcaaatccaatgattganatctccaagcctaatatgaggtcctgtgtggacaactgcttgtctcagcccaaatgccacaaaatataacaggtctgagtaatttatccacctatatcaaaggtgggtaaaagaattatgaaaaaaggtaaagcagggtcagtttgagatccaatactggggccaggtatatccagattcaaatataggtccagacatctacaaggtgactttgggtgaataactgaatccaagttacctaggtttcaacacctgcaccatgaagacaataatacattgatgcttatgatgattaaattatataatgtaaataaaatgctgagctcttgg

SEQ ID NO: 1189 - DNA, 661 bp, Homo sapiens
  misc_feature [331]..[331]: Chromosome 8, SNP identification no. = rs17634252
  misc_feature [331]..[331]: allele = c, c, in linkage disequilibrium with rs1399176, rs10505685, respectively
  misc_feature [331]..[331]: n is a, t, c or g
ggtcctgtgtggacaactgcttgtctcagcccaaatgccacaaaatataacaggtctgagtaatttatccacctatatcaaaggtgggtaaaagaattatgaaaaaaggtaaagcagggtcagtttgagatccaatactggggccaggtatatccagattcaaatataggtccagacatctacaaggtgactttgggtgaataactgaatccaagttacctaggtttcaacacctgcaccatgaagacaataatacattgatgcttatgatgattaaattatataatgtaaataaaatgctgagctcttggcttgacaaagagtggttgtngtttagagtgcacacatcaagataaaggaagtagttaatttttatgtatagaaagtgtttgggtgactttttagatgaaatgacagataagctgagattcaaaagacaaatgaaagtttgcaaggtagagagaagggaaaaatattctggatatagcaagtgctatgcacaaagacaggagacaaactccttatgtggaaaccacataacagtaatcatatttttctttacatttcatagcaagttgggggcactggaatgcaatgtttctgcttaacagaaatgttggcaatattcttaagatagtgttcatgatgagaagaattataa

SEQ ID NO: 1190 - DNA, 661 bp, Homo sapiens
  misc_feature [331]..[331]: Chromosome 8, SNP identification no. = rs17634276
  misc_feature [331]..[331]: allele = c, c, in linkage disequilibrium with rs1399176, rs10505685, respectively
  misc_feature [331]..[331]: n is a, t, c or g
tgagtaatttatccacctatatcaaaggtgggtaaaagaattatgaaaaaaggtaaagcagggtcagtttgagatccaatactggggccaggtatatccagattcaaatataggtccagacatctacaaggtgactttgggtgaataactgaatccaagttacctaggtttcaacacctgcaccatgaagacaataatacattgatgcttatgatgattaaattatataatgtaaataaaatgctgagctcttggcttgacaaagagtggttgttgtttagagtgcacacatcaagataaaggaagtagttaatttttatgtatagaaagngtttgggtgactttttagatgaaatgacagataagctgagattcaaaagacaaatgaaagtttgcaaggtagagagaagggaaaaatattctggatatagcaagtgctatgcacaaagacaggagacaaactccttatgtggaaaccacataacagtaatcatatttttctttacatttcatagcaagttgggggcactggaatgcaatgtttctgcttaacagaaatgttggcaatattcttaagatagtgttcatgatgagaagaattataataaaaggacttcccagaaaagaataaaaaattcctccttgaattgtgtattcatgt

SEQ ID NO: 1191 - DNA, 661 bp, Homo sapiens
  misc_feature [331]..[331]: Chromosome 8, SNP identification no. = rs11778762
  misc_feature [331]..[331]: allele = g, g, in linkage disequilibrium with rs1399176, rs10505685, respectively
  misc_feature [331]..[331]: n is a, t, c or g
tgtatcttcctacatttattgtccagagtataagttctcctaggcagagagttttcaaaattataacgttcactgaacattaaatgctaataattttattcttcctttcctaacactttgcagttccagctgggccgagaactcaaagtgtgaagctaaagtacaaaagctggtatgagaggtatttcaggaaaggagtacaggctgaagtattgcaaatgtctttgaagaatactggtgctttgctgttcccagcttcatttagcagccttgagaaattagaggagatttttattagcatcttatccctctatgttcaccagcactattnggtaggaataaaatttaaatcttgctagctattttctttgttagaatcattaaatacttccgcttgggaggaattattaaagagaaaagggagtatctcttcctgacagcctgcttggtgtcactgtattgcttaatcctcacaatgttgtaatagtttgtgttgtccccatttgcaaatagaaaatgaatgcacaagaggtaaaactgctaaaaacagacagcaccaggatactagtacttctcacacattaaaggccaactttaaagacatcaccatggatcagcttaggctgatcattaaatagacgtgctttactgctaacaaatt

SEQ ID NO: 1192 - DNA, 661 bp, Homo sapiens
  misc_feature [331]..[331]: Chromosome 8, SNP identification no. = rs1514202
  misc_feature [331]..[331]: allele = a, a, in linkage disequilibrium with rs1399176, rs10505685, respectively
  misc_feature [331]..[331]: n is a, t, c or g
gagttacatgctttaaaaatcacatgcatttttgaaaaataaaaggatacacatgctaaactatgttttttaaataaagaattgtagcacgggatgagaaataaatcaattcaacacctaaagcaatggaaaagcacagcataaactatttcagaaagtctggtaattaatgtaaagaagcaaattgcattatatcactcattacttaataaaaaattgagcatttattttccagggaagacaaatgtggttggggttcctactttataacatttggtgtggatttttacaagattattatgcaatccgtcaatggactgtgggcggtgcngggcagcacggattccaaatatttacaaatcacatgcattaccttgaattgtgttattacggcctccacaaccattgtgccatcaactcaaaggaagaaatatcttcctcaagctctatttgaaggctaaatatatcttcccacctttgtttctactattctaatttatcacctggtcattttctgacatctccctttaatacagcttcgttttacacctctaggtcttttgatgcacgctcttaggcatctctgccttactgctgcacacatccaccatgttattcagactcacattttcacctactcttccagcttctctcacacctt

SEQ ID NO: 1193 - DNA, 661 bp, Homo sapiens
  misc_feature [331]..[331]: Chromosome 8, SNP identification no. = rs1514203
  misc_feature [331]..[331]: allele = g, g, in linkage disequilibrium with rs1399176, rs10505685, respectively
  misc_feature [331]..[331]: n is a, t, c or g
gggatgagaaataaatcaattcaacacctaaagcaatggaaaagcacagcataaactatttcagaaagtctggtaattaatgtaaagaagcaaattgcattatatcactcattacttaataaaaaattgagcatttattttccagggaagacaaatgtggttggggttcctactttataacatttggtgtggatttttacaagattattatgcaatccgtcaatggactgtgggcggtgcggggcagcacggattccaaatatttacaaatcacatgcattaccttgaattgtgttattacggcctccacaaccattgtgccatcaactcnaaggaagaaatatcttcctcaagctctatttgaaggctaaatatatcttcccacctttgtttctactattctaatttatcacctggtcattttctgacatctccctttaatacagcttcgttttacacctctaggtcttttgatgcacgctcttaggcatctctgccttactgctgcacacatccaccatgttattcagactcacattttcacctactcttccagcttctctcacaccttttctcaatgtgagccctaggagtcatcctaactaccaagcttggttaactgtattatgacaaagagagaatgtcactctcttccaaaagc

SEQ ID NO: 1194 - DNA, 661 bp, Homo sapiens
  misc_feature [331]..[331]: Chromosome 8, SNP identification no. = rs1514204
  misc_feature [331]..[331]: allele = c, c, in linkage disequilibrium with rs1399176, rs10505685, respectively
  misc_feature [331]..[331]: n is a, t, c or g
gtctggtaattaatgtaaagaagcaaattgcattatatcactcattacttaataaaaaattgagcatttattttccagggaagacaaatgtggttggggttcctactttataacatttggtgtggatttttacaagattattatgcaatccgtcaatggactgtgggcggtgcggggcagcacggattccaaatatttacaaatcacatgcattaccttgaattgtgttattacggcctccacaaccattgtgccatcaactcaaaggaagaaatatcttcctcaagctctatttgaaggctaaatatatcttcccacctttgtttctacnattctaatttatcacctggtcattttctgacatctccctttaatacagcttcgttttacacctctaggtcttttgatgcacgctcttaggcatctctgccttactgctgcacacatccaccatgttattcagactcacattttcacctactcttccagcttctctcacaccttttctcaatgtgagccctaggagtcatcctaactaccaagcttggttaactgtattatgacaaagagagaatgtcactctcttccaaaagccaaggcttctaatgatcacgtaggtggataatcacctgtttatatacttgttagtcccactagattg

SEQ ID NO: 1195 - DNA, 661 bp, Homo sapiens
  misc_feature [331]..[331]: Chromosome 8, SNP identification no. = rs12676904
  misc_feature [331]..[331]: allele = t, in linkage disequilibrium with rs1057083, respectively
  misc_feature [331]..[331]: n is a, t, c or g
ttttgccatgttggccaggctggtcttgatctcttgaccttgtgatccccccgcctcggcctcccaaagtgctgggattacagaaatgagccaccatgcccggccaggacaccttttctcctgctgtcctcagacagggtctctggttttcagactctagatgtggactctgttgcaccagtggcctcccgggggctctcaggcctttagcctcagactggggcctgtaccatcagcttccctggttctgaggctgccagacctgcactgagccaggctcccagcttctccatttctccagcttgcaggcggtttatcatgagacttcgcntctgtgatcataagaaccaattccccattgtgtggtttttgttttgttttgtttttttgatatggagtttcgctcttattgccctggctggagtgcaatgacacaatctaagctcactgcaacatctacctcctgggttcaagcgattctcctgcctcagtctcccgagtagctgggattacaggcatgtgccaccatgcctggctaattttgtatttttagtagagacagggtttctccatgttggtcaggctggtctcgaactcccgacctcaggtgatttcgcccacctcggcatcccaaagtgttgggattataggcgtgagccac

SEQ ID NO: 1196 - DNA, 661 bp, Homo sapiens
  misc_feature [331]..[331]: Chromosome 8, SNP identification no. = rs4961309
  misc_feature [331]..[331]: allele = t, in linkage disequilibrium with rs1057083, respectively
  misc_feature [331]..[331]: n is a, t, c or g
tcttggttcactgcaacctgtgcctcttgggttcaagtgactcttgtgcctcagcctcccgagtagctgagattacaggtacccaccagcatgcccggctaatttttgtatttttagtagaaatggggtttcaccatgttgccaaggctggtctcaaactcctgacctcaagtgatctgcccgcctcggcctcccaaagtactgggattacaggtgtgagcccccacgcctggccgaaaatatctttttagcagtattcctcttacatgtaatttgtcagagttgggtcattagctcaccctgtgaccaacgactggccaaagggcatganattactaggactggtttatgccaattaagatttgtatcttttttttttttttcttttgggatatggagtctcgctctgtcacccaggctggagtgcagtggcgtgatctcagctcactgcaagctccgcctcccgggttcacaacattctcctgcctcagcctcccaagtagctaagactacaggcgcctgccaccacgcccggctaattttttttttgtatttttagtagagacggggtttcaccatgttagccaggatggtctcgatctcctgacctcgtgatccgcctgcctcggcctcccaaagtgctgggattataggtgtgagc

SEQ ID NO: 1197 - DNA, 661 bp, Homo sapiens
  misc_feature [331]..[331]: Chromosome 8, SNP identification no. = rs1057083
  misc_feature [331]..[331]: allele = c, a
  misc_feature [331]..[331]: n is a, t, c or g
gacgatgtgttctcgtcgatgtgttctcccaggaaaccaggtgtgtcctttgttcggtatcactactgtataaaacttcgacaatctacaaaacaaagggatcgaccgataataaaaacataccgaacagaaagagaaaactcatacacactcttgtcctacccaattgtaatcccttctcgtgtcttctccttccttcctttcttccttccctccctccctttcctctctcttatccctactcttcgagtcgaacatcttaaccgtccactacaaacgtcagtaattagtaaactcttcatctctctcttcggttcgtcctttagaagtntgaccttttcttcacgagtggtaattttttttttttttttttttaggtcacaccaagtgtcgacattagggtagtgaacctccgactccgtcctctttatgcacttcggtcctcaaactctggtcggacccgttatattgttctgggtgtagagatgtttctcttttttttacattttttttcttcgaaatttggattctgccgtcttaagttctgacaacaggaactcttgaaggaccgagacctttttcgagtcactcaatcagagtaggacagcaatcgagacaaaaaatccccgagtgaaacagaagtgctgtcatggaacgtggt

SEQ ID NO: 1198 - DNA, 661 bp, Homo sapiens
  CHRAC1
  misc_feature [331]..[331]: Chromosome 8, SNP identification no. = rs6578111
  misc_feature [331]..[331]: allele = g, in linkage disequilibrium with rs1057083, respectively
  misc_feature [331]..[331]: n is a, t, c or g
gcagcactctggtaggccgaggcgggcggatcacgaggtcaggagatcgagaccatcctggccaacatggtgaaaacccgtctctactaaaaatacaaaaaattagctgggtggcgcgtgcctataatcccagctactcaggaggctgaggcaggagaattgcttgaatcggggtgttggaggttgcagtgagccgagatcgcactgcactccagcctggcgacagagcgagactctgtgtcaaaaaaaaaaaaaaaaaaaaaagttaagttggaccccttactcttccaagggcctccccactcattcagagcgaattctgcggtctccncggccttccctggtctggcccctgaccatctcctgcctctctcctcccagctgctgtccccttggtactgccggcctcctgagggccacgttcctgggttctcgtaatcatcttctacctggtctctgtgattccggccttacgcgcacccacgccctcccagccggcagctgcagggatccttttaaaactgcccgggactccactgctcaaaccctaccaccacttcccattttccttagaaaaaaaaatccaacaggacctagccccgggctgcctgtcagacctcggcgagcacgccaggctctgcacaccgtctctcggagcagt

SEQ ID NO: 1199 - DNA, 661 bp, Homo sapiens
  CHRAC1
  misc_feature [331]..[331]: Chromosome 8, SNP identification no. = rs4246131
  misc_feature [331]..[331]: allele = t, in linkage disequilibrium with rs1057083, respectively
  misc_feature [331]..[331]: n is a, t, c or g
gtaaattcatatatgtatattttggaatcagttcttataaacagctcgattcagttttagctaaatttatagtttaggtagtatgttacatttgaatttttgtcttaagaaaagttgactgttcagatatttttctactgtaaagaaatatacttttctattaaagatctgtacatatttttacagtaaaatgctttatggaactagttttagagccctctatggctttaaggccttgcttactgcctgcaaattttgagaaatttaaaaataagcattctaacacttttattcccacagaaaaattccaagtcaaattatcaaatcaaanacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcctctcatttcattatctttttttttttttttttaaagacagattctcactcagttgcccaggctggattgcggtggcgctgtctcagctcactgcaacctccgcctcccaggttcaagtgattctcctgcctcatcct

SEQ ID NO: 1200 - DNA, 661 bp, Homo sapiens
  CHRAC1
  misc_feature [331]..[331]: Chromosome 8, SNP identification no. = rs4961323
  misc_feature [331]..[331]: allele = c, in linkage disequilibrium with rs1057083, respectively
  misc_feature [331]..[331]: n is a, t, c or g
ctttatggaactagttttagagccctctatggctttaaggccttgcttactgcctgcaaattttgagaaatttaaaaataagcattctaacacttttattcccacagaaaaattccaagtcaaattatcaaatcaaatacaaaaataagtcttacctcttgtataagcatgttgtactaaaaaaaaattttgaaacattttgtatattggagatctctctcatcttactgttctttgctttaaattcctggcacttctttttactgtctataagagaaaacctatcataagcccaattttttttttccacttagggtaaatgtttggctcntctcatttcattatctttttttttttttttttaaagacagattctcactcagttgcccaggctggattgcggtggcgctgtctcagctcactgcaacctccgcctcccaggttcaagtgattctcctgcctcatcctcctgagtagctgggattacaggcgtgtgccaccatgcccaacctatttttgtattttttagtagagacggggttcaccatgttggccaggcttgtctcaaactcctaacctcaactgatccacctgcctcagcctcccaaagtgccgccgggattacaggcgtgagccaccatgcctggccttcattatctct

SEQ ID NO: 1201 - DNA, 661 bp, Homo sapiens
  CHRAC1
  misc_feature [331]..[331]: Chromosome 8, SNP identification no. = rs10216653
  misc_feature [331]..[331]: allele = g, in linkage disequilibrium with rs1057083, respectively
  misc_feature [331]..[331]: n is a, t, c or g
accaatcgataggacagttctgccacccaggacattcccctctgttcctctgttcctctcttctcctgccccctagcaaccactggtgttttctgtccctcttgttcattgacatttattttaaaataaaatattttaaaatctactttttggtgtacagttctgagttttggcaaatgcagtcaagtcactaccaccaccacaattaacagctatatcaccctccagtaaattccctgtggtcagctccttccccaccttttaccgtggcaaccgtcaagctattctctgtccctataccaggtgtcatcaaatttttttctggaaaggnccatgcagtaaatagttcaagctttgtgggcttttatagtctctgttgctgctgctgaactcagctgttgtagcacgaaagcagccaggtaattactagatgaaggaatgcaggtggctgtgtttcaatagagctttatttctgcaaactgaaacttgagttttgtgtaattttcatgtgtcatgaaatactgttttctccaaccatttaataatgtaaatacttgctagcttatgtgccattaaaaaatgacttgatttggcttacagaccagtttggtggcctgtcttttccagaatgtcatataaatggaatcattcagtatgtagc

SEQ ID NO: 1202 - DNA, 661 bp, Homo sapiens
  CHRAC1
  misc_feature [331]..[331]: Chromosome 8, SNP identification no. = rs4610723
  misc_feature [331]..[331]: allele = a, in linkage disequilibrium with rs1057083, respectively
  misc_feature [331]..[331]: n is a, t, c or g
ctggaaagggccatgcagtaaatagttcaagctttgtgggcttttatagtctctgttgctgctgctgaactcagctgttgtagcacgaaagcagccaggtaattactagatgaaggaatgcaggtggctgtgtttcaatagagctttatttctgcaaactgaaacttgagttttgtgtaattttcatgtgtcatgaaatactgttttctccaaccatttaataatgtaaatacttgctagcttatgtgccattaaaaaatgacttgatttggcttacagaccagtttggtggcctgtcttttccagaatgtcatataaatggaatcattcngtatgtagcatttgagtctgcagttgttctgtttagcagaatgcatttgagattcatccgtgttgtcacaggtatcagcagtccattcctttatattgctgagtaggattccattgtatggatgtatctgtttatccattttccaggtatatggataattacccatttagattgtttctagttttgatgattgtaattttttttttttttttttttgacagggtctcactctgtcacccaggctggagtgcagtggcatgatcatggcttactgcaacttccgcctcctgggttcaagcgattcttgggtctcagcctcctgagtagctg

SEQ ID NO: 1203 - DNA, 661 bp, Homo sapiens
  misc_feature [331]..[331]: Chromosome 8, SNP identification no. = rs7388327
  misc_feature [331]..[331]: allele = c, in linkage disequilibrium with rs1057083, respectively
  misc_feature [331]..[331]: n is a, t, c or g
cctcccagtgatgggattataggcataagccaccacacctggccttgatgactataattaataaagccctataagtatttgtgtacagggtttttgtttgtgttttttgagatggagtctcgcaaactctgctgcccagggcggtgtgcagtggcgcagtcttggctcactgcaacttctcctatctaggttcaagccatcctcctgcctcagcctcctgagtagctaggattacaggcgcccaccaccacacctggcaaatttttgtatttttagtggagatggatttttgccatgttggccaggctggtttcgaactcctgagctcaancaagtgacccgcccacctcagcctcccaaagcgctgggattacaggtgtgagccactgtgcatggcctgtgtacaggttttgtgtgaacacgggatttcattttacttgggtatatgcttatgagtggaatgcgatacagacgtttataagaagaaactgccaaactgttttccaaagtggctgtgccattttgcagtcccaccagtagtgagttccagtggctctgcagctcctacaaaaattcatgtcagtttttgttgagttttgagagatttatatattcttaatacaagttatttgcctgataggagatttgcaaacattttctc

SEQ ID NO: 1204 - DNA, 661 bp, Homo sapiens
  misc_feature [331]..[331]: Chromosome 9, SNP identification no. = rs744567
  misc_feature [331]..[331]: allele = c, in linkage disequilibrium with rs719725, respectively
  misc_feature [331]..[331]: n is a, t, c or g
atctcatgacgaaacgagtttccttttacacttttctattaattataagtttgtgtgtataaataatcggatcgtacgatttttatacactcgacacccaggatccatggagtcctgtcgactaatgtccttgtgaggagtgtcttccttccctgtcttcttttacgtgtccctgaaaatccttctattcaacctgacctccagtctctgactgggtccctagtaggtactcacagtcagtggataggacctatgtacacatttaaagcctagagatggactcaacctccgacgaaatttcaacagagtttacctaaggagaggtcctctntacggacgactcttgagttttcttgcaaggactattaaagattttctaagttaggaattttgaacaaaggtttgtctgaatattccttcgactaaaaactccgtctccggaattttcacagtatatgttcaccgtagtaaaattcaggtttcactttgggaactaaaattattcgatcaaataattgatttcgacaaaagaatacaatgtcataaagtcgtgtaaagtaagttgtatttttcttataatttatagggaccaacaccctctcacaaataaaaagagttttaatagatcgtaaaacgaatgtcacgaaacttataaactgaa

SEQ ID NO: 1205 - DNA, 661 bp, Homo sapiens
  misc_feature [331]..[331]: Chromosome 9, SNP identification no. = rs17756142
  misc_feature [331]..[331]: allele = a, in linkage disequilibrium with rs719725, respectively
  misc_feature [331]..[331]: n is a, t, c or g
aactatcacaaggacaaaaaactaaacaccgcatgttctcactcataggtgggaattgaacaatgagaacacatgaacacaggaaggggaacatcacacactggggactggtgtggggtgaggggatgggggagggatagcattaggagatatacctaatgctaaatgatgagttgatgggtgcagcacaccaacatggcacatgtatacatatgtaacaaacctgcacgctgtgcacatgtaccctagaacttaaagtataataataataaaattaaaaaaagaaaaaaagaatctgctgctcggcatcccaaagcacaatggtttagangccaagtgtgtctgacccctccagtatttgactgtttgcttggggtttattgttttgcataatacaacaacctaaaatgtctccaatattttctttctttagaatatgaaacatgactctcctccccttccccgtctccctgtttccccctagagttttctttctttcttttaaaaaacatagaaatatagcttctatctggagcataaataaagacgagtaagattcaattcttttaacgatgtggataaaattaggttttcttaagggcactcttaaatatgtgagctacatggagaaaatattcaccctgacactgctgccttcact

SEQ ID NO: 1206 - DNA, 661 bp, Homo sapiens
  misc_feature [331]..[331]: Chromosome 9, SNP identification no. = rs1322166
  misc_feature [331]..[331]: allele = t, in linkage disequilibrium with rs719725, respectively
  misc_feature [331]..[331]: n is a, t, c or g
ctagaatgccttaattttttttcttttcactcttatatttcatttcctttactttttgctctatcatcagagatgtcttcaactttattgcctaatccttccattgagtttattgcttttgtgatcacatgtttagtttccaagacctcctttttattctgtaaatattcttttatagtgttctcttttttcattattatatcttccctcatgtctctaagaatattaatgataatttaaaattgttattcttctccctacattgtctttatcttttccaaattattttttatgtttgtatgttttgttttctttcttttgtatataaagncttcctcaaatgtctgataatctttggttgccttctcatatttaacagtgaggggctaaaaagctaattggaagctctgagtatctgagtaacacttcccactgtgagctctgtcattagatattctacagggcccttctagttgggaacttccaatatcagtaggtgatatgccaaaagctgtttggtagctaacctgtcagccactctgccttctatctttgctaatagaacactgacttttttagataatttgtccaatacaaagtatgcaatagtcccaaggaagcagaagcagctaaacagtgtataatacagcatccaaagggc

SEQ ID NO: 1207 - DNA, 661 bp, Homo sapiens
  misc_feature [331]..[331]: Chromosome 9, SNP identification no. = rs17705436
  misc_feature [331]..[331]: allele = c, in linkage disequilibrium with rs719725, respectively
  misc_feature [331]..[331]: n is a, t, c or g
aggactgcctcaggaattggtgaaggctcgagtctgtagatgggaatcatcatctgtagaaagttgggaaagacattgagcagaggaaataagacagtgacagacaacatgtagagcttgctagaaagggaaaataattcatataagggcaacatagttgaagcaaaagggaaaagactgataattacttatacacaccattatggccatacctactataaaatataaaaatacttccttactagttggcacatagcagctctactaagtcctcaaagtgtcctcctttccttaccctgccacctcttagtccctcctgagatggtctagnatagaaggcctcttggaccctgcttcagccactgtccattctggttgctaatgctcatgcatcatcagttattccatattttgctatgttcctgagaggcttaacctacattgtggctatatgtgtgcctgtctgagtcattcgattgcatgcaaatgaacaaattcacaaatatttttgcataagcaacccaaccatttaatacctttataaatatgagtgcagagatattccaagaggtcgtggaaagaattttcatcaataaagaggtctttctcatactaatctgaggcaacctggaggctctctggtctacatagcaattcttta

SEQ ID NO: 1208 - DNA, 661 bp, Homo sapiens
  misc_feature [331]..[331]: Chromosome 9, SNP identification no. = rs4742179
  misc_feature [331]..[331]: allele = c, in linkage disequilibrium with rs719725, respectively
  misc_feature [331]..[331]: n is a, t, c or g
cttgaaagccccttcctcccttacgtattaacccatgtaaatgggcatgacagaggaggggaatacagttcttcagacacaactggactctgaatcttaatttgattcccccagtacccctaccaccattatataccaccaaagagggtgaataacagcaataagctctaatgttgatttaatacaccgatagtatattttgatgtcagacaggaaaatcctaacctatagtacacctaagtatttttaagctaattagtccaaataggagagctgctgaaagaaaatatcatcctcatcctaaatgaagatcaacttaaccactgaaatntgaagactgatagcagtaatgcttgctgttgtaaactgcagtcaatattcctgttcatgctggagaatatggagaggtgactacatatattattgatggagctgggctatgatgtgagatagtagtgaaaataacttgcaaattgaaatcaaatataatattctggctttccacaagaaaagcccaactaccaattttctcttactcttaaaacattctgactggagtagggtttcagctatgtgccttattttcaggcttaattagatatttaagtatttttccttgcattcagctagaattatagtagttgaacaccagaaaaaaaac

SEQ ID NO: 1209 - DNA, 661 bp, Homo sapiens
  NYD-SP25
  misc_feature [331]..[331]: Chromosome 9, SNP identification no. = rs10758764
  misc_feature [331]..[331]: allele = a, in linkage disequilibrium with rs719725, respectively
  misc_feature [331]..[331]: n is a, t, c or g
tttttttttttttttttttttttttttttttttttgagacggagtctcgctctgtcgcccaggctggagtgcagtggcgggatctcggctcactgcaagctccgtctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggtgtgagccaccgcgcccggccacattattgatatanagaaatgatactgaatttatatcctgaaactttactgaagtcatttatcagttccaggagccttttggtggagcctttcgggttttctggatatggaatcatatcatctgaaaaagaaataatttgacttcttattttcctatttgaatgacagggtatgtcttgatgtgggatctggcaactaagtgtctgaaaagctcagttttgctatgagaaaaaaaaccattctctgtcaaaaggaatcaaggcttaataaaagatttcatagtatacactgaaggatgaggaagcttataaagaaaataggcatcaaggttggtggttgaaata

SEQ ID NO: 1210 - DNA, 661 bp, Homo sapiens
  misc_feature [331]..[331]: Chromosome 9, SNP identification no. = rs10491836
  misc_feature [331]..[331]: allele = c, in linkage disequilibrium with rs719725, respectively
  misc_feature [331]..[331]: n is a, t, c or g
ttctgcttttaaacaaaaatatcgtgtttattcaaagccaatctgagaccctactctgtatcaagaactgtcccaggttctgaaagcatagaattagacatcgtatgtgccctctagaaacacttagactttcaaatcattataattcaatgagtcctaaaatagagctgtgtgccagagataaaagaagtcctgaggaaggggtgttcaactctgtcttggtaggtcagtaaagactttagagagacagaaagtcttagaggactaggagaagtttgccagacagacaagaatagaacattccagacaacatgcagaggaactgagtcanaaaggaatgtataagaatggcatattctaggaactaacactgtggctagagaggaaggggaaatggtgttacatgagtgagggaggggaaatggtgttacgtgagtaagaaaaaataagcagggggcaaaatcataagtagtcttacatactacattagatatcaatatttaagcctgtaggaaatgggaggcattgaagcacttaagtaaaaaagtaactatcaaatttttgttttagattactctggtcatcagagaaatagattaagtatttaagaggtagaatctctcagacttaggaaccaactgcatgaggcggggcttggggg

SEQ ID NO: 1211 - DNA, 661 bp, Homo sapiens
  misc_feature [331]..[331]: Chromosome 9, SNP identification no. = rs16924356
  misc_feature [331]..[331]: allele = g, in linkage disequilibrium with rs719725, respectively
  misc_feature [331]..[331]: n is a, t, c or g
gtcctgaggaaggggtgttcaactctgtcttggtaggtcagtaaagactttagagagacagaaagtcttagaggactaggagaagtttgccagacagacaagaatagaacattccagacaacatgcagaggaactgagtcacaaaggaatgtataagaatggcatattctaggaactaacactgtggctagagaggaaggggaaatggtgttacatgagtgagggaggggaaatggtgttacgtgagtaagaaaaaataagcagggggcaaaatcataagtagtcttacatactacattagatatcaatatttaagcctgtaggaaatggnaggcattgaagcacttaagtaaaaaagtaactatcaaatttttgttttagattactctggtcatcagagaaatagattaagtatttaagaggtagaatctctcagacttaggaaccaactgcatgaggcggggcttggggggataaatttgcaagataataaggatgtagaattgaaaaggcctgatattattgaagctggagttgcacattcattttgctttggcttttttgtatcagtggtcatgggcaccaaataaaatgcttccatgaacatttggattctggctctaaagtttcctcgagatttcctttttccaccagcttctac

SEQ ID NO: 1212 - DNA, 661 bp, Homo sapiens
  misc_feature [331]..[331]: Chromosome 9, SNP identification no. = rs721352
  misc_feature [331]..[331]: allele = c, in linkage disequilibrium with rs719725, respectively
  misc_feature [331]..[331]: n is a, t, c or g
cctacacatctaccatgacacaagtctcatgactttaattgatgttaaataacaagttcggaaggggaccttcaacgttcggaagtcatgtaagatcacaaggttttaacaatgtagtgtaactaagtggtcgagttaacaatagattcatctctctgtctaaagaacacggagggtgagatagtagaaatactttaggagagaggtgtcaacaaagtcatctcactacgagtaggaaaaaggaatgtaatgtcaggcgtccgttctttcactttaagacacgggtctacgtttaggaatcgccttagttggacacggtagtaacaggggnactatccacctcggtagttcgtgtaacggaccgtgatagtcctttggacgtgtcaagacccagtcaccaacgattagtggagagaaatcaggtgtgttcggaactctcatctcgtacattattttcatgcaagaaagtttagactttgaaccgtaaaactacctagtctttcgtctcctcggagatcttttacgaccgcttaaagaaaccctcactacgatcataaaaagaccccgtacatactatgattacttgtatcccgaaccataagatagtagtaggaacggtcgtcgtacctttcacaatagacacccttcatattgaaagtta

SEQ ID NO: 1213 - DNA, 661 bp, Homo sapiens
  misc_feature [331]..[331]: Chromosome 9, SNP identification no. = rs7850988
  misc_feature [331]..[331]: allele = a, in linkage disequilibrium with rs719725, respectively
  misc_feature [331]..[331]: n is a, t, c or g
cgcccggctaattttgttttggtatttttagtagagacggggtttcaccatgttagccaggatggtctcaatctcctgaccttgcaatccacccacctcggcctccgaaagtgctaggattacaggcgtgaaccactgcgcccagcctagagtgttacaactttaaataccaaatgtaatccccatggcaaccttaaagaaaatatctgtagaatgtacacaaaagaaaatgacaaaggaatttaaatatttcactataaaaattaaacacaaaagaagacaataatgtaggaaacaaaaggtaaataagatgcatggcatataaaaaacntgcagcaaaatgacagatttaaattcctccttatcagtaattactttaaatgtaaatggagtaaactctctaatcaaaagacacagattgccagaatgcataaaaatacatgatctagagaggttccaagacagccaaataggaacagctccagtctgcagctcctagcgtgaccaacgccgaagacaggtgatttctgcatttccaactgaggtaccaggttcatctcactggggcttgtcagacagtgagtgcagcccacaaagcagggtggggcactgcctcacccgggaagcccaagggtccaggaattccctttcctacctaagg

SEQ ID NO: 1214 - DNA, 661 bp, Homo sapiens
  misc_feature [331]..[331]: Chromosome 9, SNP identification no. = rs731585
  misc_feature [331]..[331]: allele = a, in linkage disequilibrium with rs719725, respectively
  misc_feature [331]..[331]: n is a, t, c or g
caaaaaaaaatacatgatctaagcaagacggctcagcagaagccctagtgcttgtcctcctcacaaagacagccagaacaacaaataagatatatttttacaaaaatagtggagagagagagcagaagtacaccagaggaataacagaaacttgggatggccatataaagaatacaagaaaatgccaggactgaaccatctcattccccaactggaatcagctgggaacaaggaggaacttcttcctatagtgaggaaataaagcaagaagttcccagcagctcccatcaactccttggacacctacagacctcaccactggagtcctctngagtcctcacagacactaaacccagctaagggagcttcctggagtccacatagctgtgttcttcccagagaaggagcagacactgcggctcacacagctactgcactataccatcttagtgttggtaccatggctggagtgtgtcttgctctggggttgagtagccaaggctccctttcatgtctgaggctaagccaccactaaaccaccccatcccagtggcctgacacactcaagccaagatgcaagctgctgttatacccttctccacagaaccaagcagacgtggagccactctacctacccctaccactgcccctttgggctgga

SEQ ID NO: 1215 - DNA, 661 bp, Homo sapiens
  misc_feature [331]..[331]: Chromosome 9, SNP identification no. = rs2169282
  misc_feature [331]..[331]: allele = g, in linkage disequilibrium with rs719725, respectively
  misc_feature [331]..[331]: n is a, t, c or g
caaataagtgagtatgaatcaggtcatgaacttatctaccacagaaaccctctctacttgttaaatctcatacccctgccagaaatgagaaaagtcaccaaggttaaggtaatagaaatcaccaattcttgtcttctgattctccctgcacatcttcatgtatatctactctctcagttttctggtgccctcagctcacccagaccatattattaaccctatgccacttcaatctcccttaacaaccctgtgaggggaacctgagagtctcattaactgggttctggatttagggtcactgttgtcaaaactctggtaactgttctcactngaaagttatggatcagaagggcagtcttgggaaccagtgggaaagctagggaaacactaccaccctgactaggaggaagagcctatgttcatagcatattatttttgttttatgaaaaagtttatctgttcacccaacaaatatttgttgcatttttaccatgtgtcaggtacagtttaggtgctagggatacagcagggagcaaaacagaccaaaattctgttttaggcagtgtggtggctcatgcctataatcccagcactttgggaggccaaggcaggaggatgacttgaggccaggagttcaagactagcctcagcaacatagcaa

SEQ ID NO: 1216 - DNA, 661 bp, Homo sapiens
  misc_feature [331]..[331]: Chromosome 9, SNP identification no. = rs16924428
  misc_feature [331]..[331]: allele = a, in linkage disequilibrium with rs719725, respectively
  misc_feature [331]..[331]: n is a, t, c or g
aggtgatccacccaccttggccgcaggtgtgagccactgcacccggccaaaaaaattttttttaattagccaggtgctgtggcgcatgcctcgagtcctagttaattaggtggttgaggcagaaggatggcttaaacccaggagtttgagcttacagtgagttagttacagtcacaccactgcactccagacagggtcagagcaagaccctgtctcttaaaaaaaaaaaaacaactgtcttcatggagtttatgttcacattgggggggaagtaaattaaattacaacataataaacatccatatatccattgcaagcttaagacccagcntaactatttaccagcctatttacataccctcgactctcaccagagcctttcacgtagcctcctgatggggttggttgaggagctgagaaaggggtgcaccttcgcagcagtcattgtggacaccttcttttattcctggcctgctgtcacgctgaaccttttttctccctctaaagtccttgcttctgtctgactccaaacctttggctctctgcagcccaaattttgagcctacctgtggcccttaaaacttggtatttaaaccaggtattcccatcaaatgcctcttatcttttcctaacagattttttctgacttagtttgcccctt

SEQ ID NO: 1217 - DNA, 661 bp, Homo sapiens
  misc_feature [331]..[331]: Chromosome 9, SNP identification no. = rs10975552
  misc_feature [331]..[331]: allele = t, in linkage disequilibrium with rs719725, respectively
  misc_feature [331]..[331]: n is a, t, c or g
agaagataggcaactcacatgtttggggtcaccaaagattggccaatttgcaatatgtacatttgtcaaggaggcaaacatatttataaaaataaaagctagcatttatatgccacttactgtggacaaggaactattctaatgtttttcatgccttaattcatttaatccttattatagctctttaagataggtttttaattattcctgttttacagattaagaaaccaagactcaaagaaattgatggggctcaggacatgctaccccaaaaatatggcacctcagcattgtgaacattttaagctgaagaaatttgagaaaacaatcngggcacctgtaatcccaggtactcaggaggctgaggcaggaagaaggttgcttgagcccagggtttcaagggtgcagtgagctatgatcacaccactgcattccaacctgggcaagagagtgaaaccctatccctttaaaaaaaaaaaaggaaagaaaagaaatttgagaaaacagcagaagcaggaaggcaagtctcactttcctcatctccctcccttctcccatcaagcaggtcataaaacctaggaaggattttctgacctttccctgaagcaggttataagaccctcatgtgagaagtgtcttcctatgcctgggaaagaggaac

SEQ ID NO: 1218 - DNA, 661 bp, Homo sapiens
  misc_feature [331]..[331]: Chromosome 9, SNP identification no. = rs10975553
  misc_feature [331]..[331]: allele = t, in linkage disequilibrium with rs719725, respectively
  misc_feature [331]..[331]: n is a, t, c or g
aggaaagatatttttccttccctatgaggtaaagtaactttcccaaaaacacactgctaataagtggcagaaatggggtttgaacaaggattctgaatatagaccaccaccctccttatccattatatggcatatttataacacctgaccctccaaccaactaatcgacctgggccttgtctgaaaggcaatggaggttctaattatttttgtatgtgattaaaataaatgttcttccttcggatatccatatagctaattccctcacatctgtatggaataaattacgtccctccccaaatttatatgttgaatccctaatccccagcantcagtgcagtatccgacacacagcaagtgatcaataaataaatgacaagaagaaagaaagctcaggaattgactgagtcttcctcagaccaaactccatgggacaggaaggaggcagggctgagccaagaagagggacctggcttatgcttagaaatggggtaagcatgatgacaaattacagcttcaacaaaagatcagggtagctggagtcagaaaggcaaattcatccaaaccaagaaggcatcttaagacgctaaaaactgaagagcatgaaggaagccaaagactaattctgccatagatctggttgttaagcctcgtggctctt

SEQ ID NO: 1219 - DNA, 661 bp, Homo sapiens
  misc_feature [331]..[331]: Chromosome 9, SNP identification no. = rs7022186
  misc_feature [331]..[331]: allele = t, in linkage disequilibrium with rs719725, respectively
  misc_feature [331]..[331]: n is a, t, c or g
gtatgtacatctctagactctgttacacagcatattatggaatacagtgaaatggaaaatgacaattaaacaaagaaataaaattactcaacatgtttagttagttctgctcagaaaaatagagttaaattaaaagctgtaccttcagctgtgccctgaaggtacaccaaagctttgttaaaccagaaagcctgggaacctcagagcttgtctcccccaagaggcctttaattcttgcctttttcactgaaaatgcaggaacttgctccaggtcttccaaatacgcccagcacctcagaggtttgaggattaaactcagcatttcacaggntggctgctaaactaatgctacaacccaacttttatcattaatggtagaaactgtctccttaaaatattttccaaatcagaatgccaatcatatttggattctggcacagagattttaaatatttagtacttgctatcttaaaaagaactgctcatgaacactggcttgctgatacatattacatgataaatgtaaataaaagttatcagatgctacatggctattcaaagcctctatacctccaattaatgttaattttattaaggaatagtaagtcaatttataagctaagacatctggctagttattccagaggaaaatagagttcat

SEQ ID NO: 1220 - DNA, 661 bp, Homo sapiens
  misc_feature [331]..[331]: Chromosome 9, SNP identification no. = rs7851246
  misc_feature [331]..[331]: allele = g, in linkage disequilibrium with rs719725, respectively
  misc_feature [331]..[331]: n is a, t, c or g
catactctagggcattatcatgtccaagcttcaaggagccaacctaatagtatatttagaccagccctaggtcccagaacactgaatcccgagtcatgggagaagatcccataaccagtgaattctctcctattcatctttatatttttcccccaacgtgatatcctcaaaatcaacttctacacatgttgctgggtttcctgcttgtatataatggtcaaattcagccatttgtttgataagtaagctatttcttccctgagcaaggactgtaccttccctctcaggctatgctgaagtacaatcctggttattggcctggaagcagtcnggtgtggtggaggcagcttgtgaggcgagcaaatatcatcttgttaggcacctgctttaggtgagattcttgcatagtctctaggcagggggaagcagttatcctttagcaaaggggagcagatggattgcattggcccagaaacttcaggtgaattttcagttcaggattcttaggtttattcattcagatagccttatcccaagtctgtgtgccctcttcaccatctgggaccagactataatatagtatattcattgaagctgcaaatttaatttcctttacatctctactgtccttataattagaatctggatctgattttctatt

SEQ ID NO: 1221 - DNA, 661 bp, Homo sapiens
  misc_feature [331]..[331]: Chromosome 9, SNP identification no. = rs10975558
  misc_feature [331]..[331]: allele = c, in linkage disequilibrium with rs719725, respectively
  misc_feature [331]..[331]: n is a, t, c or g
ggtggatcacctaagatcagaggttcaagaccagcctggtcaacatggtgaaaccctgtctctactaaaaatacagaaattagctgggcgcagtggcagtcacctcccagctacttgggaggctaaggcaggagaatcacctgaacctgggagacaggggttgcagtgagcacagatcgtgccactgcactccagcctgggcgacagagtgagactctatctcaaaaataaataaataaattagttaattaattaaacagtagggcagggaaggagaaagggcaaacacaaaggagtgtattactaagctgaccacagctttacaaggcangcaactaatcgctcagtgtcatgggatctttcaagaaagaccacatgagtcctgtgtcttgaaatcatctgtcagggagaagaaggtggacaatttatctgcttctcctttctgactcctgtctctttttagccaagtttgccccacagggcataatgcctcagtacttccgtgttctctctgggcatcccttagttccagatggatcagataggggtctaaagttcctgccattagcagccaagaaccatggaacccatagggttagacggatctgtaaaggcacataacctagcacaagtgaggggaaaatgacatctcacaactaga

SEQ ID NO: 1222 - DNA, 661 bp, Homo sapiens
  misc_feature [331]..[331]: Chromosome 9, SNP identification no. = rs7875812
  misc_feature [331]..[331]: allele = a, in linkage disequilibrium with rs719725, respectively
  misc_feature [331]..[331]: n is a, t, c or g
tgggcgcagtggcagtcacctcccagctacttgggaggctaaggcaggagaatcacctgaacctgggagacaggggttgcagtgagcacagatcgtgccactgcactccagcctgggcgacagagtgagactctatctcaaaaataaataaataaattagttaattaattaaacagtagggcagggaaggagaaagggcaaacacaaaggagtgtattactaagctgaccacagctttacaaggcacgcaactaatcgctcagtgtcatgggatctttcaagaaagaccacatgagtcctgtgtcttgaaatcatctgtcagggagaaganggtggacaatttatctgcttctcctttctgactcctgtctctttttagccaagtttgccccacagggcataatgcctcagtacttccgtgttctctctgggcatcccttagttccagatggatcagataggggtctaaagttcctgccattagcagccaagaaccatggaacccatagggttagacggatctgtaaaggcacataacctagcacaagtgaggggaaaatgacatctcacaactagagccatacaaacttataaaaactgtcaaagagaaaccaacctggacacactagttaaagaaactaaagtcagattctactcagta

SEQ ID NO: 1223 - DNA, 661 bp, Homo sapiens
  misc_feature [331]..[331]: Chromosome 9, SNP identification no. = rs719724
  misc_feature [331]..[331]: allele = a, in linkage disequilibrium with rs719725, respectively
  misc_feature [331]..[331]: n is a, t, c or g
aggctgtggggggaggtgggaagggagatgaatgaaatcatttatactgagtgtctgcaactcttataggccaaggttgaggcttagtcaaaaagagcccaagtttggccaaatagagtctttgtcaggacatccacgaactaagggctgtatagtgtctgatacatatcactatttggcatcagccaattctcttgtctagaatattccataccatcatacaataccatagatgcaaaagtgagccttataaagctagtacctttactgcctttcactcatttattcattcattcattcatttacttacttattacttactaactttctntggccttttatttcaagcattttttaacttctggagaaatgatgattatgttcaatgagatatatataagatagcatcaataaacattagttctcttttctgtcaaacttcactaagagatcctctgataacaactctttgttttcccaggtgattctctcaacaaatttcctgtttagtggagccctggattttctgactcgtgttcatgtattttgtctcacacttctttgagtaggctagggcatttaacagttccctgcctgattcacagatggagtcaggccttctgtgactcctactttggccttctagagccacagatactct

SEQ ID NO: 1224 - DNA, 661 bp, Homo sapiens
  misc_feature [331]..[331]: Chromosome 9, SNP identification no. = rs719725
  misc_feature [331]..[331]: allele = a, c
  misc_feature [331]..[331]: n is a, t, c or g
gccaaggttgaggcttagtcaaaaagagcccaagtttggccaaatagagtctttgtcaggacatccacgaactaagggctgtatagtgtctgatacatatcactatttggcatcagccaattctcttgtctagaatattccataccatcatacaataccatagatgcaaaagtgagccttataaagctagtacctttactgcctttcactcatttattcattcattcattcatttacttacttattacttactaactttctttggccttttatttcaagcattttttaacttctggagaaatgatgattatgttcaatgagatatatatangatagcatcaataaacattagttctcttttctgtcaaacttcactaagagatcctctgataacaactctttgttttcccaggtgattctctcaacaaatttcctgtttagtggagccctggattttctgactcgtgttcatgtattttgtctcacacttctttgagtaggctagggcatttaacagttccctgcctgattcacagatggagtcaggccttctgtgactcctactttggccttctagagccacagatactctcttcagatttcaactctgcccagacccctgggcattctcttgctaacattcattgactctagcaggcca

SEQ ID NO: 1225 - DNA, 661 bp, Homo sapiens
  misc_feature [331]..[331]: Chromosome 9, SNP identification no. = rs7860427
  misc_feature [331]..[331]: allele = g, in linkage disequilibrium with rs719725, respectively
  misc_feature [331]..[331]: n is a, t, c or g
gaggccaaggtggatggattgcttaagctcaggaattcaagaccagcctgtgtaacatgacaaaaccctgtttttgcaaaaaaaaaaaaaaaaaaaaaaaaaaaaactaaaacttagctgggcatggtggcaagtgcttgtagtcccagctactcgggaagctgaggtgagaggatctcttgagcacaggaggtcatggctgcagtgagccatgttcacaccactgcactccagcctgagtgacaaagtgagaccctgtctcaaaaaggaaaagagagagagagagaaaaaaaaaagacccaacagtctgttgcctaaagacacacatagnctggttcatcttttagtctttctactcaagaaagatataagtagtttacacacaattacaatgttataatattctgtgacatgcaaatggaaaccaaaaaaaaaaagcagaagtagctatacttatatcagacaaattaaatttcaagacaaaaactataaaaagagacaaagaaggtcattatataatagtaaaggggtcaactcagcaagagggtataacagttgtaaatatacatgcacccaatactggagcacccagatatataaagcaaatattattagagctaaagagacagatagacccaggctgggcgtggtggctcatgcc

SEQ ID NO: 1226 - DNA, 661 bp, Homo sapiens
  misc_feature [331]..[331]: Chromosome 9, SNP identification no. = rs7025295
  misc_feature [331]..[331]: allele = t, in linkage disequilibrium with rs719725, respectively
  misc_feature [331]..[331]: n is a, t, c or g
taatggaatattatgcagaaccatcaaaaatattaaaataggtttacatataatgagaaggaaatgtattttgttaagtgttgagcgaaagctatacacacatagaaaaatgtctgagaaaggatggggaggggagaaagagttgggcagggggaaaaggggagaaatattctttgttctggagaatattagggtgaggcatacatgtatataaagatttattttcctcagaacacattatagagcaaaagcaataaagatatgttacctggattttcaaataaaattaagatatttacagtggataaactctgtggttatagttgctggngaaaaagaacagattgtaaatttttctgacttgaatgttgaaaattaaattaagaatgccttctatgtctataactttaagtgatcataatatcatatttgaaactctgatgacgggtttggactttttaaaaagaggaagaattatctgagagcaagcacaccaaaacttgccagcacacaagaagcacttcagatctgcagagtgaacagccacaggttcttctcttgcctctatactgtgtttatttataaagcaggaaagccaagtcagaacaacaatcatctttcaaaacaatttatctcagcacagtgtttgtctttgagtttt

SEQ ID NO: 1227 - DNA, 661 bp, Homo sapiens
  misc_feature [331]..[331]: Chromosome 9, SNP identification no. = rs7850497
  misc_feature [331]..[331]: allele = t, in linkage disequilibrium with rs719725, respectively
  misc_feature [331]..[331]: n is a, t, c or g
atttacagtggataaactctgtggttatagttgctggtgaaaaagaacagattgtaaatttttctgacttgaatgttgaaaattaaattaagaatgccttctatgtctataactttaagtgatcataatatcatatttgaaactctgatgacgggtttggactttttaaaaagaggaagaattatctgagagcaagcacaccaaaacttgccagcacacaagaagcacttcagatctgcagagtgaacagccacaggttcttctcttgcctctatactgtgtttatttataaagcaggaaagccaagtcagaacaacaatcatctttcaanacaatttatctcagcacagtgtttgtctttgagttttgtgtgcactacatatttgttttctcactgcacagttttagaatgtattcatttgaattattgggtcctttgttttttcaaggaaaagatttaatcttaactacctagctttagaaagcaaaatctctcttgctttttttttttggagacaaggtctcactctgtcactcaggcactcaggctggggtgcagtggcatgaccactgctcactacagtcttgacctcccaggctcaagcaatcatgacctcagactctcaagtaggtgggactataggcatgtgccaccttgccc

SEQ ID NO: 1228 - DNA, 661 bp, Homo sapiens
  misc_feature [331]..[331]: Chromosome 9, SNP identification no. = rs10217561
  misc_feature [331]..[331]: allele = a, in linkage disequilibrium with rs719725, respectively
  misc_feature [331]..[331]: n is a, t, c or g
tatggtgccaggactggtcttgaactcctgagctcaagtgatcctccctctttggccttccaaaaagcaaaattttttaccaatttaggatttaatatgaaccattaaaaaaaggagctttgaaaataatcacatctagattttttaatttgtaaagtaaaaagatcagttttctttcccacagtgtcagctttctattcagttgtttttttgttatttgccaatgatcttatttctattttagataagttgaccgaattttctaagctcaatattcaacatgtggctacaattcattcagtttttagccatctgaatatctatctggctnaagtaatttttaaatccctaaatttgttccaggggtttttctaatagtaattcatcctttatttaaggtattttgctctttataattgggagtaagttgtaatcttaaaaggaaggtggttaatcagagaatttcaagttcacaagtgtagcattacctcattggcctttctagctgcctatttcatggacaaaaattagatccctctttgtggataggaaataaaggagaaaaatagggaagttcaggagtcttcaagactgaagaaagcctttaagaatgaagccaggcagtcctgaaatggagttagacatcaattgtggactgaat

SEQ ID NO: 1229 - DNA, 661 bp, Homo sapiens
  misc_feature [331]..[331]: Chromosome 9, SNP identification no. = rs10815428
  misc_feature [331]..[331]: allele = c, in linkage disequilibrium with rs719725, respectively
  misc_feature [331]..[331]: n is a, t, c or g
agaattgttcgattttgggagactcaaagtatgcacactttcacaaaatatttgctagtttagagtgaagttatgcctccttattcctgtgtaaatctagtagaaaacacatgtgcatgcatgcacatgcatcacacatgcacgcatagcacacgttcccacattcagacatacccatatatgtgtgcatatacacagcatacatacatgtacacatacatacatgcctgcatgtgcatgcatgcacagtaccatacctttcaaaaatcagaagaactaaacaatctctcatcaatacccttagctgcagaacctatagaagattataaangtagcttttctttacctttggccacattaacgttttttgttgttgttgttgttgttgtttttgaggcatagtctcgctctgtccccaggctggagtgcagaggcatgattttggctcactgcaacctccatctcccaggttcaagccattctcccacctcagcctcccgagtagctgggactacaggtgtgtgccaccactcccaggtaatttttgtatttttagtagagatgggtttctctatgttggccaggctggtctcgaactcctgacctcagtaatccacctgcctaggcctcctgaagtgctgggattacaggcgtgagccac

SEQ ID NO: 1230 - DNA, 661 bp, Homo sapiens
  misc_feature [331]..[331]: Chromosome 9, SNP identification no. = rs7045097
  misc_feature [331]..[331]: allele = t, in linkage disequilibrium with rs719725, respectively
  misc_feature [331]..[331]: n is a, t, c or g
ggaggcagaggcagaagaatcgcttgaaccctggaggaggaggctgcagtgagccaagatcacgccattgcactccagcctgggcaacagagcaagactctgtctcaaaaaaaaaaaaaaaagatgaccataattattcccctcccaatatacacactcctttgcaatgagactttgcagctcctcctatcaagaggaagaatcaattttccctctccttgaatctgggctggccttgtgacttgctttagccaataaaatctgttgaggtgatcctgtgccaattccagtcttggacctcaagaggccttggaggcttccactggctctnttagaaccctatccagtcactgtgtgaataagtcgaggctagacccacatagtacactgacagattatcttgggtaagaaatactctgccagaagatcctgagatgtgcatggagacaagtttgacgggttataaattgtattgcaatttacaaaggaaagcacttgaggctgggtttggtggctcacacatgtaatcccagcactttgggaggccgaggcaggtgaatcacttgaggtcaggagtttgacaccaccctggccaacacggcgaaaccccatctccactaaaaatacaaaaattaccagggagcagtggcacacacctgta

SEQ ID NO: 1231 - DNA, 661 bp, Homo sapiens
  misc_feature [331]..[331]: Chromosome 9, SNP identification no. = rs10758783
  misc_feature [331]..[331]: allele = c, in linkage disequilibrium with rs719725, respectively
  misc_feature [331]..[331]: n is a, t, c or g
cactgcaacctctgtctcctgggttcaagtgattctcctgcctcagctgggattacaggcatgagtatctgggattacaggcaagcaccatcatgcctggctaatttttgtatttttagtggagatagggtttcaccatgttagccaggctggtcttgaactcctgacctcaagtggtcctcccaccttggcctcccaaagtgccaggattacaggtgtaagccactggcgcccagccctcctaaattttgttaaacactgtcatcagtataagaaatgagctaattgattcaaagaccctcagaaatgttcggcaataggaatgacaaantgcagaaggcagaggaaggcataagattgaaaatggggatacattgcaagtctttagtgagaatcccaggtccccactcctacctgagctatcggattgtccaaagaaccagggtcactcactgcagaaaagaagtttattctttggacaaagttcaaagttatttggacaaagttcaaggggaagcctccagagaaacaagagggtcaattgaaagctaaagaacactggccagggaggaaggagaccagaggtttaaactttaacactctttcattggttacatgtccttgtgcaaatcatttcaccatttgctaaagagaaggttag

SEQ ID NO: 1232 - DNA, 661 bp, Homo sapiens
  misc_feature [331]..[331]: Chromosome 9, SNP identification no. = rs10739097
  misc_feature [331]..[331]: allele = c, in linkage disequilibrium with rs719725, respectively
  misc_feature [331]..[331]: n is a, t, c or g
agctgggattacaggcatgagtatctgggattacaggcaagcaccatcatgcctggctaatttttgtatttttagtggagatagggtttcaccatgttagccaggctggtcttgaactcctgacctcaagtggtcctcccaccttggcctcccaaagtgccaggattacaggtgtaagccactggcgcccagccctcctaaattttgttaaacactgtcatcagtataagaaatgagctaattgattcaaagaccctcagaaatgttcggcaataggaatgacaaattgcagaaggcagaggaaggcataagattgaaaatggggatacantgcaagtctttagtgagaatcccaggtccccactcctacctgagctatcggattgtccaaagaaccagggtcactcactgcagaaaagaagtttattctttggacaaagttcaaagttatttggacaaagttcaaggggaagcctccagagaaacaagagggtcaattgaaagctaaagaacactggccagggaggaaggagaccagaggtttaaactttaacactctttcattggttacatgtccttgtgcaaatcatttcaccatttgctaaagagaaggttagaccagaatgagctctaaagtagattttcatagtaaaaatatgtg

SEQ ID NO: 1233 - DNA, 661 bp, Homo sapiens
  misc_feature [331]..[331]: Chromosome 9, SNP identification no. = rs7865955
  misc_feature [331]..[331]: allele = c, in linkage disequilibrium with rs719725, respectively
  misc_feature [331]..[331]: n is a, t, c or g
ctcactgcagaaaagaagtttattctttggacaaagttcaaagttatttggacaaagttcaaggggaagcctccagagaaacaagagggtcaattgaaagctaaagaacactggccagggaggaaggagaccagaggtttaaactttaacactctttcattggttacatgtccttgtgcaaatcatttcaccatttgctaaagagaaggttagaccagaatgagctctaaagtagattttcatagtaaaaatatgtgattctattaaaaagaaagagcacactttgactaatttaatatgactaatttaagtaatgagcaaccatattaantgctttttagccaatggaaattctagtgcatttcttgtaacatgtagtcctttctaaaatagcattagagattataatccaaatcctccagttaagagaatttaatggtttccccgccccatgggaccaatgataagagtatggaacacgatatagggaatggaaagaatatgcatgcatctaggactagcgactgcaaatatgtaacaacccctgaacccaaagcaacaggggagggaaagataggttaccagaacatggaagagcgagtcacgtggagcaggtcacctgaagaggacaagtgacatcatgcaaaggcaagagacagcc

SEQ ID NO: 1234 - DNA, 661 bp, Homo sapiens
  misc_feature [331]..[331]: Chromosome 9, SNP identification no. = rs7857628
  misc_feature [331]..[331]: allele = a, in linkage disequilibrium with rs719725, respectively
  misc_feature [331]..[331]: n is a, t, c or g
caggaagggtgtgttttgttacatatacaatcattacttgcagttatttgtttataccctaagtcgcctactgcatatgtaaatttatgtttccagatgtaattcatttggtctgcaggacaaatacatcatttttgagtcttacatctctaaactctgtgcttaacaatatagattgtttgggatctatacacaaatcctatacagtctcagtagatacctaattttgagacagtcatcttatcccctccccacccctgcagttctccattaaagccccatcacattaagaaagataaatctcataagagtgtgtacaggaggtcttaanaagtccctctttaagaactttcctatttctcttcaatacgtcaaacttctatttccagtggtcagttagacatctccagctagacagatgctatattttggatgcatttcaaatgcaacacagctcatttggaactcattgtattttcccgacttgcctcctctacaagttcagagcatcaccatctgctcgagccatcaatttaaatctcctaagctagaaacttgggaactgttctcaacattccattttcctcatcctttatatccacaatcctacaagttttataggctcaattttctagaatactctggaatacatcctctcctc

SEQ ID NO: 1235 - DNA, 661 bp, Homo sapiens
  misc_feature [331]..[331]: Chromosome 9, SNP identification no. = rs4288438
  misc_feature [331]..[331]: allele = t, in linkage disequilibrium with rs10512028, respectively
  misc_feature [331]..[331]: n is a, t, c or g
gcacagtacagctgctctatgaaaacatggccagactgtctcttgaaatgggtccctgagccccccttcctcctcactgggaggaacctcacaaccagggccttcagccaccaccactggtgttctctggcctacacagatttgaaaactccttgggactgagatcccagaaggaggagtggaccaccatctttgctgtttggactacttgggctttgaagagtccaagctgatcagaggtggaagcaatacccaagcacagcatagctgccctacaaaaatgtggcctggctgctggctgctatttttaaagcaggttcccaatcctgtncctcatcgtcaggtggagccttccaaccagggtctctggctacccccgccagtgttctccagctaacaggtttcaggcctccctgggatggagttcctagaggaggacctggcagccatctttgctgtttgggcaacgtagccattccagccttcaagctttggagtgtccaaggcgaccagaggctgaagcagacccccacagagcatggctgctctacaaagatgtggccagtctgctttattaagtggatccccaatcccattcctcctcactgggtgagacctagccacctcctacaggtgtgttcaagctggcattaggtccata

SEQ ID NO: 1236 - DNA, 661 bp, Homo sapiens
  misc_feature [331]..[331]: Chromosome 9, SNP identification no. = rs6560355
  misc_feature [331]..[331]: allele = t, in linkage disequilibrium with rs10512028, respectively
  misc_feature [331]..[331]: n is a, t, c or g
gagtggaccaccatctttgctgtttggactacttgggctttgaagagtccaagctgatcagaggtggaagcaatacccaagcacagcatagctgccctacaaaaatgtggcctggctgctggctgctatttttaaagcaggttcccaatcctgtccctcatcgtcaggtggagccttccaaccagggtctctggctacccccgccagtgttctccagctaacaggtttcaggcctccctgggatggagttcctagaggaggacctggcagccatctttgctgtttgggcaacgtagccattccagccttcaagctttggagtgtccaaggngaccagaggctgaagcagacccccacagagcatggctgctctacaaagatgtggccagtctgctttattaagtggatccccaatcccattcctcctcactgggtgagacctagccacctcctacaggtgtgttcaagctggcattaggtccatacctccctggaacggaactcccagtgggaggagcaggctgccatctttgctgttttgtagccttcactggtgataccttcaggtactgaaaaatctaagctgactagggactggagcagatccccagcatatcacagcagctctatggaaaagtggccagactgttatatggatgtc

SEQ ID NO: 1237 - DNA, 661 bp, Homo sapiens
  misc_feature [331]..[331]: Chromosome 9, SNP identification no. = rs1585251
  misc_feature [331]..[331]: allele = t, in linkage disequilibrium with rs10512028, respectively
  misc_feature [331]..[331]: n is a, t, c or g
ttaaacgtaaacagattactaatcactatgactggtccagtcgttagtgaataacgttagtcgggtcttccctctcaagcacgatactcgggttcggtccccgagggacaaactactactcgtcaacacccacacaccctggactctctctacctgactggaggagagaaacccaactgacgttgaacaacctccatacctattccgtgaatcccagaaacggggaagtaatcggactcccatcgttcctgtcaaggtgacgtctccgtcaccgtctgtccgaaagtcaacggggagactccgagacaggtccctcattgtcgactatggncgaactctcgagaacaacccccaccgatctccgggtccggatctcctggacgggtcactcctctatacccttacctgtaggtatattgtcagaccggtgaaaaggtatctcgacgacactatacgacccctagacgaggtcagggatcagtcgaatctaaaaagtcatggacttccatagtggtcacttccgatgttttgtcgtttctaccgtcggacgaggagggtgaccctcaaggcaaggtccctccatacctggattacggtcgaacttgtgtggacatcctccaccgatccagagtgggtcactcctccttaccctaacccctag

SEQ ID NO: 1238 - DNA, 661 bp, Homo sapiens
  misc_feature [331]..[331]: Chromosome 9, SNP identification no. = rs4745250
  misc_feature [331]..[331]: allele = c, in linkage disequilibrium with rs10512028, respectively
  misc_feature [331]..[331]: n is a, t, c or g
aacgtccctctctaaggagaagacacttaagatgtgaatgaaagtgcacttccatataactttatctagaaaaatcacaaaggtcagccctgcaggaggagggaaaataggtagtcttacacgatttgttttcctggagtgcagggtgagaagacatcctgatgaaaacacatcatctaatcttatatgtctatgaactgagatattttcataatattaactgtgtgaaatatcccttacccatccctcagtcactgcccagctttcagtcttaaagggactcccaaatattgaatctgacatgccacttgttatggacggaattatgttncctcaagcatcacatgttgaagtcctaagctcccagtgtgattgtatttgaagacagaacccataaaaacgcagttatgtttaaattaagtcacatgggtgggttccgaatgcactatcacttgtgtctttataagaagaaggagagatatcagggatgggtacatacggagaaaaggccatgtgagaatatagtgagaaggtggccatctaaaagccaggagaaaggcctcaggagagatcagacctgccaagatgaccttgtacttccagcccctagaactgagagaaataaacttctgttgtttaagccacctaatctgtggcattt

SEQ ID NO: 1239 - DNA, 661 bp, Homo sapiens
  misc_feature [331]..[331]: Chromosome 9, SNP identification no. = rs7044457
  misc_feature [331]..[331]: allele = t, in linkage disequilibrium with rs10512028, respectively
  misc_feature [331]..[331]: n is a, t, c or g
aaattaaaatgaataattattaaaaagcaaaattttacccagtaaaacaatgccaaagacttcaaatgacaatgtaaagagatttgttccaaatgagcgccaatgtttaatgttttccgctactgtatttttggagatttttgggatatatttctaatttctgttattctcctctcagatggtttccatttagtctatttcctgatgtttcaaatccatattttcaaatgtaagtgattttcaatgaagccggttcatagctttgtttttggagtgttggagctatcatcatttaaaccagtattgttctttgagattttctagccattcncatgcctcctcaaatttcaaatagcactgcataaacatacatggagtgctttctatgcattcactcgaccctaataattttggccaacatattctgttcggttctaaggtttatggggttgtgatgtgtttgtgccaaaatgtctcagtggttgttgagatacttcccatttattttctgttgttttagagatatccaaatactttttcattaaactcagtaagatgaaagtgttcatggttgagttaacattttatattcggatacataagctctttccaaatacatcttgtaattttggtttgcatcagacttcatagttcactgtaa

SEQ ID NO: 1240 - DNA, 661 bp, Homo sapiens
  misc_feature [331]..[331]: Chromosome 9, SNP identification no. = rs2061399
  misc_feature [331]..[331]: allele = g, in linkage disequilibrium with rs10512028, respectively
  misc_feature [331]..[331]: n is a, t, c or g
taaggggtttttgcagaccaaacttagacctttagtattctgatatgtaccgttaatttcagtccaaacatatactctaaaggattcctctctttgtctttctttatctctctcttttcttctcttcctgtgacgtctcccgggaccattgagttcgaaaattccttatagatttctccattccttttttaacttctccaacttcttccttgcctttcgtcaacatggtttcagattcttctcttaaagttccctactatgtgatttacactggtgtactctagtaacgtcaggatagttctcctcctcttcacatcacagaagtatactnctacaggacctcttatatatatataaaacgaaacattctatttgacagattatagaaagttaactttcctaatacatccaatatttttgaatttttaaccgtctcgtctcacatagtgtggatatcagagtcgtgaaaccctccggttccaccctcttaacgaactcgggtcctcaaactcttgtcggacccgtcgtttcgttctgggctctgggtgtagagaggtttttctttttttttaatcgacccgtaccaccgtacacggacatcagggtcgatgagtcctccgatcccaccctcctagtgaattccggtcatccatctccgata

SEQ ID NO: 1241 - DNA, 661 bp, Homo sapiens
  misc_feature [331]..[331]: Chromosome 9, SNP identification no. = rs2061398
  misc_feature [331]..[331]: allele = t, in linkage disequilibrium with rs10512028, respectively
  misc_feature [331]..[331]: n is a, t, c or g
taaggtgtataatcctcatttttaggtaaatactgatttctcgttcataattttactcttactacaggaagtgtcctgtgtttctattggtgactattatttgtcttatattcaggtctcgagtttttgtttttaaggggtttttgcagaccaaacttagacctttagtattctgatatgtaccgttaatttcagtccaaacatatactctaaaggattcctctctttgtctttctttatctctctcttttcttctcttcctgtgacgtctcccgggaccattgagttcgaaaattccttatagatttctccattccttttttaacttctncaacttcttccttgcctttcgtcaacatggtttcagattcttctcttaaagttccctactatgtgatttacactggtgtactctagtaacgtcaggatagttctcctcctcttcacatcacagaagtatacttctacaggacctcttatatatatataaaacgaaacattctatttgacagattatagaaagttaactttcctaatacatccaatatttttgaatttttaaccgtctcgtctcacatagtgtggatatcagagtcgtgaaaccctccggttccaccctcttaacgaactcgggtcctcaaactcttgtcggacccgtcgt

SEQ ID NO: 1242 - DNA, 661 bp, Homo sapiens
  misc_feature [331]..[331]: Chromosome 9, SNP identification no. = rs2061396
  misc_feature [331]..[331]: allele = t, in linkage disequilibrium with rs10512028, respectively
  misc_feature [331]..[331]: n is a, t, c or g
actcctctctaatacttgtcgtaaaaaagttaaggtatctttgatattcagttcctgtttgtttcgttgtcaacctcagtagtctcagggactgctacataggtgtgtacagaatagtagtttcttggtcgggaaactgaaatataataactgggataaggtgtataatcctcatttttaggtaaatactgatttctcgttcataattttactcttactacaggaagtgtcctgtgtttctattggtgactattatttgtcttatattcaggtctcgagtttttgtttttaaggggtttttgcagaccaaacttagacctttagtattctnatatgtaccgttaatttcagtccaaacatatactctaaaggattcctctctttgtctttctttatctctctcttttcttctcttcctgtgacgtctcccgggaccattgagttcgaaaattccttatagatttctccattccttttttaacttctccaacttcttccttgcctttcgtcaacatggtttcagattcttctcttaaagttccctactatgtgatttacactggtgtactctagtaacgtcaggatagttctcctcctcttcacatcacagaagtatacttctacaggacctcttatatatatataaaacgaaacattctat

SEQ ID NO: 1243 - DNA, 661 bp, Homo sapiens
  misc_feature [331]..[331]: Chromosome 9, SNP identification no. = rs2061395
  misc_feature [331]..[331]: allele = g, in linkage disequilibrium with rs10512028, respectively
  misc_feature [331]..[331]: n is a, t, c or g
aaagaggaacatccaactctaaaccaattggatacgactatttttatttagaaagatatacggactattaacgttatattaaataattaacgtgacaccttttacgtctcaacggaaaaggtgtcactgtaattattttacgtgatgaagtattaatcaaggagagaaaaagggacagatagagacggatctttttcatattaccaaggaatctgaggagaattactaacgtggacttttggcattctgtttcgaaactttactgacgtaaattttaaactaatcctatgacctgttcaagagggagtacatcttcttcaagacaaatacncaaactcccttctcccctgttaaaaaatattaagaagataaatatgtatgagtgcattctacgaaatatttacgttaagttaactgaatggagttatcaacattaatacttcttatacgaaatttcagataaagtaaaatagatttaaattaatataagagatatttgtctatggtcctgattgtcgtgaaaacaaaagtatagtatgtaagtcttaacatcacggtcagttttatttccgacacgtattaataagtacaaactgaacttaatacttttgacttatgtacctacatttcatctgttccttttcaatcaaatccaccccta

SEQ ID NO: 1244 - DNA, 661 bp, Homo sapiens
  misc_feature [331]..[331]: Chromosome 9, SNP identification no. = rs10781152
  misc_feature [331]..[331]: allele = a, in linkage disequilibrium with rs10512028, respectively
  misc_feature [331]..[331]: n is a, t, c or g
ttttattaatgtcactgtggaaaaggcaactctgcattttccacagtgcaattaataaattatattgcaattatcaggcatatagaaagatttatttttatcagcataggttaaccaaatctcaacctacaaggagaaaaaaaaatgttttaaggaccaagagaatgaagtgacagttagctggtcaagagggcatgcacatacattgtgtgagtaatgaagctgtcaaaatggagagctcaagcctagtgtacaactacttagatccatctgcttgctatcgctgaaaatgttatcacaatgcaacataaaatttaagaaatgccactancctgactttcatgtgaaatttctgatttttaaacctctatttgattctttagaatcatatgagattaaataaaacaatcttgaagttcataattggacttttttgcactctggtttagactgcagcatctctaataattagtttttatttttgagatttgtgtgtttgtgtgtgtgtgtgttatattgtatgtaaagatgtggtttaataattaccagctaaatacttaaaaaaataaagggacccatgtgacaatcagaaaacaaaataaatgtctaccactcatgctatatctttgtcctgcttagacttccatgtgaaactttgtat

SEQ ID NO: 1245 - DNA, 661 bp, Homo sapiens
  misc_feature [331]..[331]: Chromosome 9, SNP identification no. = rs4745254
  misc_feature [331]..[331]: allele = a, in linkage disequilibrium with rs10512028, respectively
  misc_feature [331]..[331]: n is a, t, c or g
aattaagttaccatcctctccaagctgtgaaaatacctaaaagttaactcattacttctagcatttgttggcaaaattactaattaataatgtgagaaaatttaatgaatttgatacattttctatgtcaaaagaatagccatatcttccagcaaaagttgctttggatttttgtaagatgaatcagttttgcaagaagaggtagcaagagtgagccagctaaaagtgctatagagtttaatgtgttttcctttatctttagtgcctttattcctaaggggaacattgttcaaataaagcaggatgtactttctcattccaggagcaaaanaagtactcatattaaaaagatgaaagtggaatgttctccctttttactgcttgcgggtggagaaaataacatttggcattttctcttatttccctgcttgtctttgtcattctgccaatttgttagtacataaagatcagctgaaaacaaattggcaaaatgcaacctggaagatacatgaaaggaaacaaaggtaagaactggtaccagtagaagtttttaaggcgctcagaaaagaaaaccggagttagaaagaaatcagttgccgtgttcccttttttcacttaaatgagttgtgtccaggatcccaaacagaaacatgaaataaaa

SEQ ID NO: 1246 - DNA, 661 bp, Homo sapiens
  misc_feature [331]..[331]: Chromosome 9, SNP identification no. = rs2168884
  misc_feature [331]..[331]: allele = c, in linkage disequilibrium with rs10512028, respectively
  misc_feature [331]..[331]: n is a, t, c or g
atggtagtcataactgtaaaataaaagatattttatttatagactaatctgtagattaatctttaaattgataagggtatttgaaatcgttccgagtcaattttgaggtctcgacttctataattacttagaatgatttctctgtccttgggtgggtttcaaagtgacaccttttctgcaactttagaaccagagaagtgtccgaagggaaatttattaatggatgaaagatttttgatggagagtctaaagtaagattgtgatttaacttttaattttacttcaaaagttaaacgactcgtctataacttaccgatctacctacctaccnaccttcccacctacctactacttacctttgacttactgactaaagtaaccacacatcacggtatacaaacactttctaagttatttttcagactttttattcacctaagtgcttcgtcacggtaaattaaattttaaattaaaataaagtacaaagacaaaccctaggacctgtgttgagtaaattcacttttttcccttgtgccgttgactaaagaaagattgaggccaaaagaaaagactcgcggaatttttgaagatgaccatggtcaagaatggaaacaaaggaaagtacatagaaggtccaacgtaaaacggttaaacaaaagtc

SEQ ID NO: 1247 - DNA, 661 bp, Homo sapiens
  misc_feature [331]..[331]: Chromosome 9, SNP identification no. = rs4745255
  misc_feature [331]..[331]: allele = g, in linkage disequilibrium with rs10512028, respectively
  misc_feature [331]..[331]: n is a, t, c or g
tacagtgttgtcaaatgcctaagaaagaagaaacaggaataattttattttgatagaatctaaaaattagtcttaattaaattttaatatttctctttaataaattaatcatcacttcactttctacttatctttcttttttaagttatttaagctaattaattatgtattattattcaacatcattcatatcacagttactatctctgcttttaaaacatattgcaaagcttcatagcttaaaacattaatttgttatgtccatggtttctgtggatcttaatgatgtttaagtcttcacgaaaggcttgtgatgattcaacagccagangctgacattatctgaatgctcattcattcacctatctggcatctagaaaggggtgaatctaaaactggaattgccaatcagagtacctacatgtgacttctccacatggcttggcttactgacagcatcaagcttctcatatggtggctcagggaaaaaactacacacatgcatagacacactcacacacacacacacacacacacacacacacagaggaagaaactacattgttttttatgaggctagctcagaagttgtattccattactttggtcatattctatttagggaagcaggcatgagcctttctagagtccaagggagagg

SEQ ID NO: 1248 - DNA, 661 bp, Homo sapiens
  misc_feature [331]..[331]: Chromosome 9, SNP identification no. = rs4745256
  misc_feature [331]..[331]: allele = c, in linkage disequilibrium with rs10512028, respectively
  misc_feature [331]..[331]: n is a, t, c or g
cgaaaggcttgtgatgattcaacagccagaagctgacattatctgaatgctcattcattcacctatctggcatctagaaaggggtgaatctaaaactggaattgccaatcagagtacctacatgtgacttctccacatggcttggcttactgacagcatcaagcttctcatatggtggctcagggaaaaaactacacacatgcatagacacactcacacacacacacacacacacacacacacacagaggaagaaactacattgttttttatgaggctagctcagaagttgtattccattactttggtcatattctatttagggaagcagncatgagcctttctagagtccaagggagaggtcacaggtcctcaccttttgagcagaggagtgtctgacaattgggacacatgtttaaaatatccagagtttgcttcctgaacacaaattattttcatttttccacaggcataatacactcaccattttcctcatattactcaagttttgtcccattttagaatcaattcaaggtccaagatcttgtcacctaaatcatgtccaggtatagataatgctccagagatacattacccctgtacaatttctctgaatatgaagactcatgaactgaaaagagaagatactttccatcacacac

SEQ ID NO: 1249 - DNA, 661 bp, Homo sapiens
  misc_feature [331]..[331]: Chromosome 9, SNP identification no. = rs4745257
  misc_feature [331]..[331]: allele = a, in linkage disequilibrium with rs10512028, respectively
  misc_feature [331]..[331]: n is a, t, c or g
gaatgctcattcattcacctatctggcatctagaaaggggtgaatctaaaactggaattgccaatcagagtacctacatgtgacttctccacatggcttggcttactgacagcatcaagcttctcatatggtggctcagggaaaaaactacacacatgcatagacacactcacacacacacacacacacacacacacacacagaggaagaaactacattgttttttatgaggctagctcagaagttgtattccattactttggtcatattctatttagggaagcaggcatgagcctttctagagtccaagggagaggtcacaggtcctcancttttgagcagaggagtgtctgacaattgggacacatgtttaaaatatccagagtttgcttcctgaacacaaattattttcatttttccacaggcataatacactcaccattttcctcatattactcaagttttgtcccattttagaatcaattcaaggtccaagatcttgtcacctaaatcatgtccaggtatagataatgctccagagatacattacccctgtacaatttctctgaatatgaagactcatgaactgaaaagagaagatactttccatcacacacacacaccgtacaatgatacaataacagaacacatataggacaac

SEQ ID NO: 1250 - DNA, 661 bp, Homo sapiens
  misc_feature [331]..[331]: Chromosome 9, SNP identification no. = rs4745258
  misc_feature [331]..[331]: allele = g, in linkage disequilibrium with rs10512028, respectively
  misc_feature [331]..[331]: n is a, t, c or g
agctcagcagggatgacttgtttctattacacaatttctgtgccctcagttaggaagccacaaaaccttaggatgactcacatttccagttcctgggtttagtgcaggacataaggcccactctaggaatttccagctgaaggaatggactacagagaatttgttgctaaagaattgggagagaaaaagtaagggggttccaatagactttgagtttctctaccacactttgctagctgtagttcagaggtcaaaaaaatgctgctgctgctactgctgctaccactatttcccccactcccaaaaaccccagcataactgcttcccaccnagtcttgaatccagaacatgagattttggggtaacttgccaatcagctgctaccactatatgtgtctgtcccccttccacctttataatctcccaactgcaagagcatctggtaaatacatattttacattgtctaatcattttaactagaagtaaaagagaaaagttaatttcaactaaagcaaatctacaatcaacactggggctctcatctgctttccctgaaactgcctttctttctcagaacattgagttatgcataaacacttaatgttatccatttgtaagactgaactactgtattctcagtacttctgaagatttttcata

SEQ ID NO: 1251 - DNA, 661 bp, Homo sapiens
  misc_feature [331]..[331]: Chromosome 9, SNP identification no. = rs4745259
  misc_feature [331]..[331]: allele = g, in linkage disequilibrium with rs10512028, respectively
  misc_feature [331]..[331]: n is a, t, c or g
aagtgtgcataagcatgtgtgtgtgtgtgtgtgtgtgtatttggaatgagagaataacctttattctttgtgaactttgctatgtgtactaggattttctaccacttagatttttttgttgttgctctaatcggacaacatcataaaattgtgcttttaaaaatttaaacattttacagaaatataaagtaaaaattcattcacaattcaaccataggcttaatcaactaatttataggctttatccttctatcattttctataccaaaataaccctattgtcatgtatgtttcttgtgttggtggtgtgatgcttgaaaatataataggnattaatatgtcaaaccaatttataatttattatacacaaatgcacccagaaaacatgcaggtagacactacagtaaccccctccttagctgaggttttattttctacagtttcagttacccacataaactgccatctgaaaatattaaatgaaaaaatgttggaaataaacaattcataagttttaaattgtgcaacattctgagtagtatgatgaaatctcacactgtcccattgcatccaagccaggatgtgaactgtttctttgtccagcatataagaccctgtctatgtactggcctgttagtcagtagccttgtagcttatcagt

SEQ ID NO: 1252 - DNA, 661 bp, Homo sapiens
  misc_feature [331]..[331]: Chromosome 9, SNP identification no. = rs4745260
  misc_feature [331]..[331]: allele = c, in linkage disequilibrium with rs10512028, respectively
  misc_feature [331]..[331]: n is a, t, c or g
ttagatttttttgttgttgctctaatcggacaacatcataaaattgtgcttttaaaaatttaaacattttacagaaatataaagtaaaaattcattcacaattcaaccataggcttaatcaactaatttataggctttatccttctatcattttctataccaaaataaccctattgtcatgtatgtttcttgtgttggtggtgtgatgcttgaaaatataataggaattaatatgtcaaaccaatttataatttattatacacaaatgcacccagaaaacatgcaggtagacactacagtaaccccctccttagctgaggttttattttcnacagtttcagttacccacataaactgccatctgaaaatattaaatgaaaaaatgttggaaataaacaattcataagttttaaattgtgcaacattctgagtagtatgatgaaatctcacactgtcccattgcatccaagccaggatgtgaactgtttctttgtccagcatataagaccctgtctatgtactggcctgttagtcagtagccttgtagcttatcagttaaactgtcgttgtctcacagtgcttgtgttcaagcaacaccgattttacttaataatggcctaacgcccaagattactgtacctaatttataaattaaacttta

SEQ ID NO: 1253 - DNA, 661 bp, Homo sapiens
  misc_feature [331]..[331]: Chromosome 9, SNP identification no. = rs7389572
  misc_feature [331]..[331]: allele = c, in linkage disequilibrium with rs10512028, respectively
  misc_feature [331]..[331]: n is a, t, c or g
ttcccatggtcttcacaatccaaagaccaggagattccctcgtgtgcctacacatctctagggccctgggtttcaagcacaaaactgggtggccatttgggcagacaccaagctagctgcaggagttttgtttcataccccatgggtgcctggaatgccggtgaggcatttcccctggaaagggagctgaagccagggagccaagtggtctagctcagtggatcccactcagcatattccaccctcatggaacccagcaagctaagaaccactggcttaaaatttcacgctgccagcacagcagtctgaagctgacctgggatgctccagnttggtagggtgaggggcatccgccattactgaggtttgagtaggcagttttccctcacagtgtaaacaaagccacctggaagtttggactggttggagcccaccgcagctcagcaaagccgctatagccagactgcctgtctagattcctcctctctgggcagggcatctctgaaagaaagggagcagtcccagtcaggggcttatagctaaaactccaatctccctgtgacagagcacctaggggaaggggcgactgtaggcgcagtttcagcagacttaaacgttccagcctgccagctttgaaaagagcagcggatctcccaccaca

SEQ ID NO: 1254 - DNA, 661 bp, Homo sapiens
  misc_feature [331]..[331]: Chromosome 9, SNP identification no. = rs10746927
  misc_feature [331]..[331]: allele = g, in linkage disequilibrium with rs10512028, respectively
  misc_feature [331]..[331]: n is a, t, c or g
ctaacaaacagaaaagaatagcatcaacatcaacaaaaaggatgtctgcacaaaaaccccatccaaagatcaccaacagcgaagaccaaaggtagataaatacacgaagatgaggaaaaaccagcacaataaggctgaaaattccaaaaaccagaacacctcttctccaaaggatcacaactcttcaccagcaaggaaacaaaagtggacggagaatgagtttgatgaattgacagaagtaggcttcagacggtgggtaataacaaactccacagagctaaaagagcatgttctaaaccaatgcaaggaagctaagaaccttggaaaaagnttagaggctaactagaataaccagtttagagaagaacaaaaatgaaatgatggagctgaaaaacacagcatgagaatttcgtgaagcatacacaagtatcaatagctgaatcgattaaatggaataaaggatatcagagattggagatcaacttaatgaaataaagcataaagacaagattagagaaaaaataaaaggaatgagtaaagcctccaagaaatatgggattatgtgaaaagatcaagcctacgtttgattggtgtacctgaaagtgacaaggagaatggaaccaagttggaaaacactcttcaggatattatccaggagaac

SEQ ID NO: 1255 - DNA, 661 bp, Homo sapiens
  misc_feature [331]..[331]: Chromosome 9, SNP identification no. = rs7048840
  misc_feature [331]..[331]: allele = a, in linkage disequilibrium with rs10512028, respectively
  misc_feature [331]..[331]: n is a, t, c or g
cttcacaagtgaaggagaaataaaattctttacagacaagcaaatgctgatggattttgtcaccactaggcctgccttacaaaagttcctgaaggaagcactaaatatggaaaggaaaaaccattaccagccactaaaaaaacaaaccaaaatgtaaaggccattgacactatgaagaaattgcatcaactaatgggcaaaataaccaattagcatcataatgacaggatcaaattcacacataacaatattaaccttaaatgtagacaggctaaatgccccaattaaaaggcacagactggcaaatttcataaggagtcaaaacctatcngtatgctgtattcaggagacccatctcaagtggaaagacacacataggctcaaaataaagggaaggaggaagatttaccaagcaaatgaaaagccaaaaacaataaaaaataaaaaaaagcaaggttgcaatcctagcctctgataaaacagactttaaaccaacaaagataaaccaaagacaaagaagggcattgcataatggtaagggatcaatgcaacaaaaagaggtaactatcttaaatatatatgtacctaatacaggagcacacagattcatcaagcaagttcttagagacctacaaagagacttagactcccatacaataat

SEQ ID NO: 1256 - DNA, 661 bp, Homo sapiens
  misc_feature [331]..[331]: Chromosome 9, SNP identification no. = rs4744695
  misc_feature [331]..[331]: allele = a, in linkage disequilibrium with rs10512028, respectively
  misc_feature [331]..[331]: n is a, t, c or g
ttgctcagtaaaaagtgggagttgaataatgagaacacatggacacagggaggggaacatcacactccagggtctgtctgtgggtgagggttaggggagggagagcattaggagaaatacctaatgtaactgatgggttgatgggtgtggcaaaccaccatggcacttgcatacctatgtaacaaacctgcacgttctgcacatgtgtctcagaacttaaagtaaaattaaaaaagaaaaaaaaacaaacaacaaataatacatatacagaaatatctgctgaataccaagaatattctgattattgaagcatttttattaccactctaancttttctgcacataacacaaatggaattcattttaataacttgttttctaaactgattttaaatctatgaaggtagtaattgcatacatagataaatcacaactacattggcatttatactgaccttataaattctatgtgcttttattttcttgacatgttttattatttcagatattttagtaattgtccctatgtctctatagatacgtgtggttgtacaatattttaaaccaagataaccaactctatcctatagggcattataaacttaagatttcacaatgggggaaaaagaaaacaaagttacaggatatgtatggaacatgc

SEQ ID NO: 1257 - DNA, 661 bp, Homo sapiens
  misc_feature [331]..[331]: Chromosome 9, SNP identification no. = rs981197
  misc_feature [331]..[331]: allele = g, in linkage disequilibrium with rs10512028, respectively
  misc_feature [331]..[331]: n is a, t, c or g
tacaggatatgtatggaacatgcttatataagtgttccttcttttgcatcatcaaaagcaatataataaatatctgtatattaatgactttgtgaaggttcttactaagaaaaattttattttttgttatgaatttcttactgtatttttaacaaaaatctatggagtattttaggagatgctataacatatgactatatttgagaaaattatgttttttaatcacatctacactcaaatcacttataaaatactccattgaaaatctgttttaaatattatctcacagaacattttgatattttagcctttttggtttgtttttgcaatnttttttgttaattgagaaggacaaggtttacttcattcttgaccacccaggatataaaatcacatcatagatagctgtgtaaatccttagaaataaaagagataaccatctgttctgaacggttcaaccccaagaaaaattattagatctctcaagtttcttccagtttaattatttttctgttaggaaattttagaaaaatattgcccactgacagttaagatcaaaatatacatttgcaagtgtaccttcaatgcattctttccttattgttggggaagagcagagtgatagggatgcaggaatggttgtcctattttttctcctatt

SEQ ID NO: 1258 - DNA, 661 bp, Homo sapiens
  misc_feature [331]..[331]: Chromosome 9, SNP identification no. = rs1458489
  misc_feature [331]..[331]: allele = g, in linkage disequilibrium with rs10512028, respectively
  misc_feature [331]..[331]: n is a, t, c or g
aaatataaaaatcaaaatgcctgattttgttttaagaaactctgtataaatgaagatgaaaaaggattttattagaagaaattgtctctggatattgaactttgagccagagcatggcaagtaaaaccctttggtttgtagtgaggcagtctcctgaatgaaaaaaaaaaaaatgttgaaggaaatatcctaagaacaggttttagtacaaggccgaatgatctaaccattactggctacggaatgaaaactacacatcaacattacacaaatgggaaaagttaaagaaagggaattgtcgtgctctggagccaaagggaaatagcagcanaaaacaactcagtctgtatgtagtagcaagcacctctgtgatctctcccatagatggaaaccatagttaacttgcagagatagatagaagccaccttcattccaacttccaaatggctcttgcattgttactaacactctaaatgaaggtacttattgtcttactcctatacacatctttgaaacataaatgtttctatgagtgtaacacataagtctgagtacgtttttcaaggtatctttactctgagacaggaggctaagctaatttagtcatatgaaaacttcagggtatttgtgagagagctggggagaggttgggattagagga

SEQ ID NO: 1259 - DNA, 661 bp, Homo sapiens
  misc_feature [331]..[331]: Chromosome 9, SNP identification no. = rs1379909
  misc_feature [331]..[331]: allele = g, in linkage disequilibrium with rs10512028, respectively
  misc_feature [331]..[331]: n is a, t, c or g
aaccattactggctacggaatgaaaactacacatcaacattacacaaatgggaaaagttaaagaaagggaattgtcgtgctctggagccaaagggaaatagcagcaaaaaacaactcagtctgtatgtagtagcaagcacctctgtgatctctcccatagatggaaaccatagttaacttgcagagatagatagaagccaccttcattccaacttccaaatggctcttgcattgttactaacactctaaatgaaggtacttattgtcttactcctatacacatctttgaaacataaatgtttctatgagtgtaacacataagtctgagtangtttttcaaggtatctttactctgagacaggaggctaagctaatttagtcatatgaaaacttcagggtatttgtgagagagctggggagaggttgggattagaggaaagataaaagagaaaacaaggagaaatagaagaaaataagggggtatattgagaggagccatagagttggaatttggaaggtgttaatgtggtaaactgaattaatcaattaagcctggcatttctatgataaaatttacttcagcatatattattttttatcatttgttaataattatcctcataaatgaaagtgactataattttctttttcttactattct

SEQ ID NO: 1260 - DNA, 661 bp, Homo sapiens
  misc_feature [331]..[331]: Chromosome 9, SNP identification no. = rs1379910
  misc_feature [331]..[331]: allele = t, in linkage disequilibrium with rs10512028, respectively
  misc_feature [331]..[331]: n is a, t, c or g
agggaaatagcagcaaaaaacaactcagtctgtatgtagtagcaagcacctctgtgatctctcccatagatggaaaccatagttaacttgcagagatagatagaagccaccttcattccaacttccaaatggctcttgcattgttactaacactctaaatgaaggtacttattgtcttactcctatacacatctttgaaacataaatgtttctatgagtgtaacacataagtctgagtacgtttttcaaggtatctttactctgagacaggaggctaagctaatttagtcatatgaaaacttcagggtatttgtgagagagctggggagangttgggattagaggaaagataaaagagaaaacaaggagaaatagaagaaaataagggggtatattgagaggagccatagagttggaatttggaaggtgttaatgtggtaaactgaattaatcaattaagcctggcatttctatgataaaatttacttcagcatatattattttttatcatttgttaataattatcctcataaatgaaagtgactataattttctttttcttactattcttgcccaatttgagactcagacttattttagcctcatattatgagtttgggagcattctgtttcctggaaaagtttatatgttcctttaagt

SEQ ID NO: 1261 - DNA, 661 bp, Homo sapiens
  misc_feature [331]..[331]: Chromosome 9, SNP identification no. = rs1902976
  misc_feature [331]..[331]: allele = c, in linkage disequilibrium with rs10512028, respectively
  misc_feature [331]..[331]: n is a, t, c or g
agaaaactaatctacacaattttctggatctgagaaaactaaagagaaaacttttaaattccaccactttcctgagacttctcaatgaaacctctttatagggtcattgattttaccatatctgaccagagagtgagcagaaaaatctgcaaatataaaagaatataacaaaatattaagagttttagtaattttaataattaaatgaaatcatgtcagttggttactcttgcgttttatcctattcaataattattgggatttatgaatggtttaaccaaatacataatattgaatcatctagcattaaatctaaatatttctccacttnacttaaaatatgacctatttagcattttggctctcaactatgattatgactttaaagtttactaagagtttgccatatgtgatatttaatctaaaacattaaaattcagtatttgtttcaagccaaactttctgttttggatttttatttatccattacctttattgaatttgaaatgtttttaactttcatgtgatagtaatcttagttatatttatcaaatcgcctttttctttctaaaataaaatttgtagttttatagagaagggaagaaacaaaagatttttcctttagtcacgttaaaaattaggataacaaggaatcacaaat

SEQ ID NO: 1262 - DNA, 661 bp, Homo sapiens
  misc_feature [331]..[331]: Chromosome 9, SNP identification no. = rs1902978
  misc_feature [331]..[331]: allele = c, in linkage disequilibrium with rs10512028, respectively
  misc_feature [331]..[331]: n is a, t, c or g
taacaaaatattaagagttttagtaattttaataattaaatgaaatcatgtcagttggttactcttgcgttttatcctattcaataattattgggatttatgaatggtttaaccaaatacataatattgaatcatctagcattaaatctaaatatttctccactttacttaaaatatgacctatttagcattttggctctcaactatgattatgactttaaagtttactaagagtttgccatatgtgatatttaatctaaaacattaaaattcagtatttgtttcaagccaaactttctgttttggatttttatttatccattacctttantgaatttgaaatgtttttaactttcatgtgatagtaatcttagttatatttatcaaatcgcctttttctttctaaaataaaatttgtagttttatagagaagggaagaaacaaaagatttttcctttagtcacgttaaaaattaggataacaaggaatcacaaataatatcaaaatagtattaagatttcttctatgttatggattaaacatttcttactgaaaacaagccttttgacattatccaagaaaatatacatcatgtctatttaacaccaatggttctggatgacaagaggaaactttaagcaagtatcatggttttttaaaa

SEQ ID NO: 1263 - DNA, 661 bp, Homo sapiens
  misc_feature [331]..[331]: Chromosome 9, SNP identification no. = rs7026566
  misc_feature [331]..[331]: allele = a, in linkage disequilibrium with rs10512028, respectively
  misc_feature [331]..[331]: n is a, t, c or g
aaagtttactaagagtttgccatatgtgatatttaatctaaaacattaaaattcagtatttgtttcaagccaaactttctgttttggatttttatttatccattacctttattgaatttgaaatgtttttaactttcatgtgatagtaatcttagttatatttatcaaatcgcctttttctttctaaaataaaatttgtagttttatagagaagggaagaaacaaaagatttttcctttagtcacgttaaaaattaggataacaaggaatcacaaataatatcaaaatagtattaagatttcttctatgttatggattaaacatttcttantgaaaacaagccttttgacattatccaagaaaatatacatcatgtctatttaacaccaatggttctggatgacaagaggaaactttaagcaagtatcatggttttttaaaatttgtatatttttatctgaacgaaatcactacaattctaaaacgttaccactatgatatgttaaagcattgagaaatattgtaatattcaaatgtttggaagcatttgttcttttaatgtcagattgtgcctaagtttttggcattgtgtatctttgatagtagcatgaatacatggagtgtatttgaataggaaataatcctttgaatagtattttag

SEQ ID NO: 1264 - DNA, 661 bp, Homo sapiens
  misc_feature [331]..[331]: Chromosome 9, SNP identification no. = rs1379911
  misc_feature [331]..[331]: allele = g, in linkage disequilibrium with rs10512028, respectively
  misc_feature [331]..[331]: n is a, t, c or g
cattttacataattgagttgatattttatgtataatatcctaggagttattttcacttgacaccaagtaagaacattgtttatttcttttaatagtttttgaaaactttttttttaactaactaaataatttggataatattatagtgaaattaaccacttcactctggtatctttaagtaatgtttttgatttgtcaatgagatgaataataatataatggtaatagtaataatagattgttatttgaatatttcctctgcctaaataaatatgactttagaaatgaagcttaccacaacatttttagggctttttatatatattgtaangttatggttcagaaaagttttatctatttgcatgactaccagtatttgagagtacccgccttaagtgcactaaatattattggtaacatttgcgtagttgatcaatgtaagagtttgttcattttatatttactctattttctttagttatttgtaagaaggatttttttcctttttcaaataaccatttttaattttaccaaatatgtacattacatatttaaactgttacattttctaagaatagacttttcagaattttagttaatgtattttgttgcttatatttataagaataaataatgaggctcctttttaatgttttgatac

SEQ ID NO: 1265 - DNA, 661 bp, Homo sapiens
  misc_feature [331]..[331]: Chromosome 9, SNP identification no. = rs7027893
  misc_feature [331]..[331]: allele = c, in linkage disequilibrium with rs10512028, respectively
  misc_feature [331]..[331]: n is a, t, c or g
gtacatcttttgtggtagctcttagttttgataggttgtttttgcatttttatttgctaaaagctcaataattttagtcatgcaatgtggtttatttgggacaatttgtatattcaagcaatttgattattttctgttgatacattttgataattaactaataataatgagaaaaacagcatactcaaatatttctatggagtttttaccctaaattatcatttttctctaagcattttgtgcacattttgtgttattaaatgcaagctttattttacttatgttattgacttgttcccaccgtattaatttccttcttgtcatacccatngcaacacatgctcctctgttttcttttattcagccaaatctcttcatagatacataattgtaaaatcctaggtaagtgtttccttttctctatgtacttttaccaaatagatctcattcagcactatggtttcaaataaaatcaatgtgcaaataacatccacatttatatattcagacttgatttatccattgagctcctccaacctacttgacacctccatttgggttatctgttatcaagctccaatttacacatctagaagagaattttttttttttagtcagtctaaatgtcatccttggatttctatcctcctttttcaccacc

SEQ ID NO: 1266 - DNA, 661 bp, Homo sapiens
  misc_feature [331]..[331]: Chromosome 9, SNP identification no. = rs7039655
  misc_feature [331]..[331]: allele = t, in linkage disequilibrium with rs10512028, respectively
  misc_feature [331]..[331]: n is a, t, c or g
gattattttctgttgatacattttgataattaactaataataatgagaaaaacagcatactcaaatatttctatggagtttttaccctaaattatcatttttctctaagcattttgtgcacattttgtgttattaaatgcaagctttattttacttatgttattgacttgttcccaccgtattaatttccttcttgtcatacccattgcaacacatgctcctctgttttcttttattcagccaaatctcttcatagatacataattgtaaaatcctaggtaagtgtttccttttctctatgtacttttaccaaatagatctcattcagcantatggtttcaaataaaatcaatgtgcaaataacatccacatttatatattcagacttgatttatccattgagctcctccaacctacttgacacctccatttgggttatctgttatcaagctccaatttacacatctagaagagaattttttttttttagtcagtctaaatgtcatccttggatttctatcctcctttttcaccacccacattctacccatcaacatatgatcagtcctctaacccaaatatttcttgaatctatctgcatatattcttctcttctatgttccttcttcagctgttactgttgacctggaacctagtcgcc

SEQ ID NO: 1267 - DNA, 661 bp, Homo sapiens
  misc_feature [331]..[331]: Chromosome 9, SNP identification no. = rs4468001
  misc_feature [331]..[331]: allele = t, in linkage disequilibrium with rs10512028, respectively
  misc_feature [331]..[331]: n is a, t, c or g
gcactatggtttcaaataaaatcaatgtgcaaataacatccacatttatatattcagacttgatttatccattgagctcctccaacctacttgacacctccatttgggttatctgttatcaagctccaatttacacatctagaagagaattttttttttttagtcagtctaaatgtcatccttggatttctatcctcctttttcaccacccacattctacccatcaacatatgatcagtcctctaacccaaatatttcttgaatctatctgcatatattcttctcttctatgttccttcttcagctgttactgttgacctggaacctagtngccaatatttttttcagcatatctgcaaagtgccaatatgatatcccagttttctcttgtttagagttttgatcaatttctcacacatcatctgtaccaaacaccctcctctgctttcccgttatatatagtacatccaaactttttctactgacccaccaccctatgggatctggcattggcttatctgtctctcctcactttctttctttttttttttttttttaatttttttttttttttattatactctaagttttagggtacatgtgcacattgtgcaggttagttacatatgtatacatgtgccatgctggtgcgctgcaccca

SEQ ID NO: 1268 - DNA, 661 bp, Homo sapiens
  misc_feature [331]..[331]: Chromosome 9, SNP identification no. = rs10512028
  misc_feature [331]..[331]: allele = a, g
  misc_feature [331]..[331]: n is a, t, c or g
ctctgctgccttatcagttgttgttagtgagatctgtgatttccaatgggaattattgtcatttttcaaatttcattatttatttcaataattattgtttattctttcattgtctttatcatatatagctatttgtctacttctacttatacttctttaaagctttagtataatttttaacccctcaccagttgtcttatgctatattttttgtttatcagtatttaattctgatatatacataaaatatttagatatagattgcagaaacattgatgcctttttgtgtgtatttaacataaaattaaaaaactaaaattctaagcatacnatcatctgataaggaagttttaatcaatagttaaccaagctaagatcattggtttgagcagaggaattaacatgctattttacttacagaattgttatagctttatctattatgactatgactaggatccatttcaagttaagtttttgtattaatggaagataatggtcaagttcattgttattcctatatgattatcctgttgccatagttccaattgttgaaacgcctactgtttttctacaaatctattttggaacatttattaaaaatcagttatccataggtgtgtgtatatttctgaactctttaattatattaagaaaatac

SEQ ID NO: 1269 - DNA, 661 bp, Homo sapiens
  misc_feature [331]..[331]: Chromosome 9, SNP identification no. = rs999791
  misc_feature [331]..[331]: allele = t, in linkage disequilibrium with rs10512028, respectively
  misc_feature [331]..[331]: n is a, t, c or g
ttttttgtttatcagtatttaattctgatatatacataaaatatttagatatagattgcagaaacattgatgcctttttgtgtgtatttaacataaaattaaaaaactaaaattctaagcatacgatcatctgataaggaagttttaatcaatagttaaccaagctaagatcattggtttgagcagaggaattaacatgctattttacttacagaattgttatagctttatctattatgactatgactaggatccatttcaagttaagtttttgtattaatggaagataatggtcaagttcattgttattcctatatgattatcctgttgncatagttccaattgttgaaacgcctactgtttttctacaaatctattttggaacatttattaaaaatcagttatccataggtgtgtgtatatttctgaactctttaattatattaagaaaatacacctttaacagtgatattcaagtatttctttaattccaggaaattgtggaaaattatagtatatcttttgaaatatttttcctgtaccatttcttacatcatttttcagaaactccaaactactctatgcatttttgtgacctttcaatttctacttcttcttttttcatattttatatctctttatttctctatgcttgattgta

SEQ ID NO: 1270 - DNA, 661 bp, Homo sapiens
  misc_feature [331]..[331]: Chromosome 9, SNP identification no. = rs17059425
  misc_feature [331]..[331]: allele = t, in linkage disequilibrium with rs10512028, respectively
  misc_feature [331]..[331]: n is a, t, c or g
tttactaaacattctaaatgtatttattttaaaatatttaaaaactattctttataattaagtccatttggataaaattcatgttctgagaatttatttcttcaatacagttatgagaattaaattttctctcatgtgttttggaattataatttgccagtttatgttgagtgacatatcacacataatgttttaaactatatatataataaatatatatgtgtatttatgtttatccttcctttctttgctttcttctttatgtgtttgttgtgttcgccttttgtgatctagtagtttttcactgtgtccactagccacttcctcgtgnctcacttttggaatgccttcccacactggcttttgttctgaggtgatcctgtagatcagtgatttgttcagcaaagtacttcctacatgtgaggtcgtgccttgattcacttaccttctcaaacccctagctttctgaaaaattttagtgcagggtagcaggaaaacagacttttgtggcttatgttattgttgctccattttagttcctaaggtcaaggagccaggctggatccagtgttctatttcatgtggaatactttacttctgttgccgcgcagaagcttaattcttgggctgctgctttcagattaagaaaatagtctgtgtc

SEQ ID NO: 1271 - DNA, 661 bp, Homo sapiens
  misc_feature [331]..[331]: Chromosome 9, SNP identification no. = rs946807
  misc_feature [331]..[331]: allele = t, c
  misc_feature [331]..[331]: n is a, t, c or g
attttaagttcccactaccaccgaactccacgagagttcccttttcgaacgtcctccccttcgtctccgatttctagtccagtgttgaccctatacgtcttctgtccgtctgtagggacgtctgtccctcttcctgatgtcaccccaccgactataggtcctctttattacagggtactgaacactactaaagttccctcaagttcacttacctcttaggtaagtttataaataactcacagacgagagcttgtctctgataaagtccgtgacatttactaacttgtatacggtatataagttatgtatccttggtgtggaagtgtggganaccatgactaagtaaatagtaaaggtaaaggttgttacgtagaggacacgattactctcatactaatatagaaattttttggtatgaaaaataaaacttgtattagataatgactgaacatgtcttccggaccactcccttgttcccttagaactaaacaggtgtaagtataggtcaaggagacggtccttgctagacgtaaacattctttaaatctgctaattatcactggtacttaatatcattttacgtggtcgaatatgcactgagcatggttacagttaatttacattctaaacggacatatcgtgtcgtactcaattagttatt

SEQ ID NO: 1272 - DNA, 661 bp, Homo sapiens
  misc_feature [331]..[331]: Chromosome 9, SNP identification no. = rs7040700
  misc_feature [331]..[331]: allele = c, in linkage disequilibrium with rs946807, respectively
  misc_feature [331]..[331]: n is a, t, c or g
attacattaaacatagatctttaataaaagtatttctgagacagagtaatataacaaatcggtagtataggaggaagtcttaaatatgtgcctgtattctaggtataaaacagaagatttttattgttttactcttctatttttaaatttattttattatgcataccataaagtgtacaaatttaaaatatctgttttcatgaattttacaaaagaaacacaaccaccacacagcccagatataaataattaccagccaaccagaggcctctctcatacccacttctaatcattacttaccctatccccaccccacatcaaaggagctctnaaattgattatcaaagatcagtttacctgtctttttacttattataaatgtattacatcatgtagatttcatatactgtagactcatctgtgtcttcttcactcaatcttttacctgtaagatttgtccatgttgttgttactattctcattgttatgtagtattattccattgtattataatttcagaattaatccattcactttgtaatggacttttggattttcatcagtctgagactaaggtgaataatggtgttataaacattcttgtacacatttcagtgcacatacttaacatttctgttggatatacaatcatgctccacat

SEQ ID NO: 1273 - DNA, 661 bp, Homo sapiens
  misc_feature [331]..[331]: Chromosome 9, SNP identification no. = rs12005727
  misc_feature [331]..[331]: allele = a, in linkage disequilibrium with rs946807, respectively
  misc_feature [331]..[331]: n is a, t, c or g
ttttcaatgtacacaatctcatcgtctgtaaataatatggtttttcccctctcttttcaatatttataccctttatttttcttgctgactaggacctccagtaaaatgtcgagtaaaagtgatgataactgatatcattatgcctttccaaattcaggataaaaaattttaacaattcaaccttaaggattttttgtatatttttgaagatatccattattagatatactaacaattgtgttatgaataagtgttatcttttacaaaatattgttagtacacctattgatataatcatgcattttcttctttattctataaatgaaatganttacattaattgacttttcaaatgttaaactaatcttgcattcctggacaatgctaacttgctttccattattctttatacattctgctgggtttaacttgcaaagattctgtttggacattttgcctctatgttactaagaaatatatgttggcaaaataattggtacctgcttctcaattagtggcatcatgtggctttctgcagatgttttgtaaaggggccaataacctctttccaccaggatattgatattcagtgctgtgtctcttatacgataataaggcttcgacatccatgagcaaaatttagctaagagttttgagtttt

SEQ ID NO: 1274 - DNA, 661 bp, Homo sapiens
  misc_feature [331]..[331]: Chromosome 9, SNP identification no. = rs12347524
  misc_feature [331]..[331]: allele = t, in linkage disequilibrium with rs946807, respectively
  misc_feature [331]..[331]: n is a, t, c or g
gttagtacacctattgatataatcatgcattttcttctttattctataaatgaaatgaattacattaattgacttttcaaatgttaaactaatcttgcattcctggacaatgctaacttgctttccattattctttatacattctgctgggtttaacttgcaaagattctgtttggacattttgcctctatgttactaagaaatatatgttggcaaaataattggtacctgcttctcaattagtggcatcatgtggctttctgcagatgttttgtaaaggggccaataacctctttccaccaggatattgatattcagtgctgtgtctctnatacgataataaggcttcgacatccatgagcaaaatttagctaagagttttgagttttatgagttgtcctgtgccctggatcttcatagcaagtggtagaatggaggcagtggctcagagctttgtggacatgtctctgagcccacagctttctgttgtagataggtatgatgaatccacgtaacgatttgccttcagggtaaattccaaactcttaaatacagaacccaagacctgcaggtcctgggatctatagatctctcaagtctcataccttactctgcttcctagctccctcttgcaatctagaagtccaatgcactatccatt

SEQ ID NO: 1275 - DNA, 661 bp, Homo sapiens
  misc_feature [331]..[331]: Chromosome 9, SNP identification no. = rs10867398
  misc_feature [331]..[331]: allele = c, in linkage disequilibrium with rs946807, respectively
  misc_feature [331]..[331]: n is a, t, c or g
ggacaaaacattctgagtatttgagtgagcaggggcagggctccatgaggaggaaagttctggtccagttatgtggtgccccatagaccctgattgagtgttttccattttaattggaaaacttggcagcctcttgtttatagcacaggggataggaaatcaggcattcgtaagtgaaataaaaatagaaccaactcctcaatttaaagttctggaatcttttccttgaaatgttgcctgcaggtctctccacccaattattctgcaccaggactgctcagccactgtccaagatgatcaatcctgaacctaacaccataaaatattcaancctccataccttggactgactgctctctgggcattgtaagtgcagaacctccgtcatatttttgcctaatttttactctcatcagtaaaactagaagtaataagactcccaacgataagagatcattatgaaggaaaagtttcttcaacatttattttttaaaaacttaagttcattcttctgtcattccaaagaaaaattatccattttatcttataaaatcatatatattttacattttatctgaaatgaaactagtgcccccctacaccaccaataagtcaagaacaacaaaaagagcccactaaaaaaagaaaagattgaaaatag

SEQ ID NO: 1276 - DNA, 661 bp, Homo sapiens
  misc_feature [331]..[331]: Chromosome 9, SNP identification no. = rs10512404
  misc_feature [331]..[331]: allele = a, g
  misc_feature [331]..[331]: n is a, t, c or g
atcacttcaaatccagtgaaaaaaagagcaaaaattttttttgttttttttcccagaagtcccagcccaagttttatttgtgtcccattgactctaattgagtggatcagtcactatgttactggtgacatatgtcactatggccacatgttgtaccatgccttggtcacttgctcctccactttgactaggctggaggcaattctgcagattcaaagattctgtagcatcctgcataaagaggcttcagagaaacctgcaaaggcaggctttggttttactgtttctttaaactttcccatagtttgggagcaatattttgtgtaagganatcaagctgtgtgagaaaagaaggatggatgctgggtggaaaaacaaccctccacctatatatactttagcagcctgttcatatttgaagttctcaatgggagaatctttgcctcagatttggtttctagagccatgtcagcagctccagctgtgaggcgatgaagctggaagagtctagagaggctgtgtccaccttagaagcaccactcaatctcagcaaacaacctttattttcacttaataagccactagctcaagagacctaccaatccctggcatgcgtgctaggtggctaatttcatgatcaagaaccaacatgcttccttca

SEQ ID NO: 1277 - DNA, 661 bp, Homo sapiens
  misc_feature [331]..[331]: Chromosome 9, SNP identification no. = rs10980301
  misc_feature [331]..[331]: allele = c, in linkage disequilibrium with rs10512404, respectively
  misc_feature [331]..[331]: n is a, t, c or g
ctactaaaaatacaaaaaattaactagatgtggtggctaatacaggtacatgcctgtagtcccagccacccaggaggctgaggtgggaggattgcttcagcaccagaggcaaaggttgcagcgagcaccactgtactccagcctgggcaacggagtgagactctgtctcaaaaaagccccccccaaaaaccaaaaaagtattactgatcttacagcgttgtgcaaagagtaaatgaaattgtgtgtgtgtgtgtgtgtgtgtgtgcgcatcccttttggggaaggaaaagttactaagtaaatggtggataactggaattgcatctgctgnaaaggtaacttgtggtgacttcaactatacgaagagagagaaaataatataaacacctcctactcccagccacacacacatactgggaaattagtttgtttgcccaggtgggtaccatctcactgcacagaacggattctagtattttcaattaatatttgtggaacaatacggccctagacacaagccaactactccatctggccctccatcaaggaaatgatgatgggtttcagtgcagaagagcaaaaatgaccttactgggacaaaggactgactgtactttatggaggatcttgactgatgttacttttttcttaccctctatct

SEQ ID NO: 1278 - DNA, 661 bp, Homo sapiens
  misc_feature [331]..[331]: Chromosome 11, SNP identification no. = rs167948
  misc_feature [331]..[331]: allele = a, in linkage disequilibrium with rs2278170, respectively
  misc_feature [331]..[331]: n is a, t, c or g
caccaccaagacacccagaaccggagaacgacagtcccgtcctcccactgagtcaccgaatcgttttcaccataggtcggtccaggtccccgtcttaaaacggatgaaagacaggtgactactcgtcagatcgccaagggacatcttcccatggagaacttataactctcctgtcatatggagtgcctcctggtagacctcgaactaccggacccccactctcctctgtttaacccaaatcttaaatcttctggacttggtttttccacgttttgatcctcttattgttcaccaggatttttcctttcttgggtcctcttggtaaaggtcngaggaagggatagattggttgggactctccgttcaagggtattatttacctccgaactaaaccttcagcacactacaacaggacatgaaaagtgtcaaccaaatgggttttcgttatgaaaagtagattccgacttgtttcagaaggaacacgacggtaatcgtatagatcaggagttgttaagacctcccttacgtttaattatgttggtgagactttttgtcataccttcaaggagttttatgatttttatattgatggtactctaaatcattagggtgatgatccataaataagttttctttccttagttatacagtttctctatag

SEQ ID NO: 1279 - DNA, 661 bp, Homo sapiens
  misc_feature [331]..[331]: Chromosome 11, SNP identification no. = rs10836079
  misc_feature [331]..[331]: allele = t, in linkage disequilibrium with rs2278170, respectively
  misc_feature [331]..[331]: n is a, t, c or g
aacttccatactgtttttcagagtggttgtattaatttgcattccctccagaattgttgaggactagatatgctaatggcagcacaaggaagactttgttcagccttagatgaaaagtattgcttttgggtaaaccaactgtgaaaagtacaggacaacatcacacgacttccaaatcaagcctccatttattatgggaacttgcctctcagggttggttagatagggaaggagcctggaaatggttctcctgggttctttcctttttaggaccacttgttattctcctagttttgcacctttttggttcaggtcttctaaattctaaacncaatttgtctcctctcacccccaggccatcaagctccagatggtcctccgtgaggtatactgtcctctcaatattcaagaggtacccttctacagggaaccgctagactgctcatcagtggacagaaagtaggcaaaattctgcccctggacctggctggataccacttttgctaagccactgagtcaccctcctgccctgacagcaagaggccaagacccacagaaccaccaccaccacccctctgtcagcagaaagcagttacaaaagactgaccttcatccattttcctccaaagatttggggtcttgggctcttgagtggggggaa

SEQ ID NO: 1280 - DNA, 661 bp, Homo sapiens
  misc_feature [331]..[331]: Chromosome 11, SNP identification no. = rs191761
  misc_feature [331]..[331]: allele = c, in linkage disequilibrium with rs2278170, respectively
  misc_feature [331]..[331]: n is a, t, c or g
ccgtcgaacctggtagccctctaacagagagggaccgtgactaccggttcaatagtaaaaatctccccgtcacaccattgacgggttggtagtgaactgatatcagtctgtaaggaccacccatccaccatcccgggggaggacggggtgagtacggacagattgatggacattacaaaggggggtgagttctcgggttctggggtttagaaacctccttttacctacttccagtcagaaaacattgacgaaagacgactgtctccccaccaccaccaccaagacacccagaaccggagaacgacagtcccgtcctcccactgagtcaccnaatcgttttcaccataggtcggtccaggtccccgtcttaaaacggatgaaagacaggtgactactcgtcagatcgccaagggacatcttcccatggagaacttataactctcctgtcatatggagtgcctcctggtagacctcgaactaccggacccccactctcctctgtttaacccaaatcttaaatcttctggacttggtttttccacgttttgatcctcttattgttcaccaggatttttcctttcttgggtcctcttggtaaaggtccgaggaagggatagattggttgggactctccgttcaagggtattatttacctccgaac

SEQ ID NO: 1281 - DNA, 661 bp, Homo sapiens
  misc_feature [331]..[331]: Chromosome 11, SNP identification no. = rs7395324
  misc_feature [331]..[331]: allele = a, in linkage disequilibrium with rs2278170, respectively
  misc_feature [331]..[331]: n is a, t, c or g
catattaaaagagaatgccctgaatgggaaaaagaaaaggaagttattccccttatggcttttgaggaagattaggagggtcaggggctctgtcttttctatattgagttccaccaagagcccttgataaatttagaggagggacccaaattcaagcttattacctttttaattgactcaggggcagcttcctcctctgtttatcattccccatctggtgtaatttgttcacaagaagaactccttatttcaggagtgaagggagaaggatttaaagcaaaacctttagaggaaacaaaagtcatatataaaaatagatcagctaatatanaatttttgttaataccagaggaaggaactaacctaataggaagagatttaatgctagaattaggcttaggcctctatgttaaccagggaaaatttctcacctctctaaacttactcactactatagatgaagagtatatccatcctaatacctggtcaaaagaaggaaatcaaggaaaattatttgtttcctcaataaaggtcaaattaaaaactcttggggaagtagtaagaaaacaacaccctattcctttaaaagctaggataggtttaaaacctataattgaaagccttgttcatgatagacatcttgaaccctgtataccccctt

SEQ ID NO: 1282 - DNA, 661 bp, Homo sapiens
  misc_feature [331]..[331]: Chromosome 11, SNP identification no. = rs11032345
  misc_feature [331]..[331]: allele = t, in linkage disequilibrium with rs2278170, respectively
  misc_feature [331]..[331]: n is a, t, c or g
actccacccctcaaattcccagttcaccaacaccaacccagagatcacgtccttgtcaaaagctggaaagagggaaagcttgagcccacctggaaaggaccttacctgatgctcctcacaactgagacagcagtctgaactgctgaaaaggggtggacccatcatagccgagtcaaggtgtcaccctctccaaagccatggaccatcattccagggccaactcccaccatagtaacgttaaaatgaaaagtctaatctgtccctatttcctcttctttttcctttagttaccaaggacaccttatcatcaatgtaacccgatcacttttcncccaaacaattacatttgatgcttgccttgccatatcttgtgtggacctaaaaagtcaaagacagctcagttcttcagaaaagtatctttgtccctccgggaggacagtatgggccctcacttattatatttggggagaggttatatggaccaccaagtatcagggctggactgcaaattctgccctaaagccctacctccacctcaccaaaggaaccaccttccccatcccaattgccaaacacatcagtgcaacccaatacttatctccattactacccctacctccagtaattctaaccccaccttagagcacttctatggtttagg

SEQ ID NO: 1283 - DNA, 661 bp, Homo sapiens
  misc_feature [331]..[331]: Chromosome 11, SNP identification no. = rs10836102
  misc_feature [331]..[331]: allele = t, in linkage disequilibrium with rs2278170, respectively
  misc_feature [331]..[331]: n is a, t, c or g
agtttcaaatttccttgttgtctctgttctgtgaccaacccttcctgccttgccacacccagacatgcccagacatgccttccctcctgcctagttagtaatggacatctcttcctcccctcctttcgcaaagtgcgtgtttaccctatctggaaaagtttaagtctttttccctatttggagaagtttaagtcttagccaacctggatagcttagattgtaaggtccaactccagccaatggggaaaggacacaaacaggaattgcgttagggataaaaaccccttttctcctttgtttggtgtgctcttgcaattgtggctgatgcagnttgcaccattctacagaagtaaattgccttgctgagaaaactttttgcctgagtgctggttcttctttgcagtatcaagcatttgtttctaacattgggaagaggctggacaaatttggaggagcatcttaaaagcctagactctgatgagggcttagaggaaataaagattagggaacatttgaaactctttagagattaagtggttgtggccagaatgctggtaaaaatatgaagtgtaagggccattctgataaggtttcagatagaattgagggacaaattattgaaaacaggagtaaagatcatcgctgtcataaattggccaag

SEQ ID NO: 1284 - DNA, 661 bp, Homo sapiens
  misc_feature [331]..[331]: Chromosome 11, SNP identification no. = rs11032351
  misc_feature [331]..[331]: allele = t, in linkage disequilibrium with rs2278170, respectively
  misc_feature [331]..[331]: n is a, t, c or g
gggggttaattttggccccttacactgagattcaggagcaaaggcataatttaaaaacaggatttatgattaaaaggaaagtaaagtggaaagatttggaaaactctcagcctcttgatgtaaagaatgaaaaagtgtgctcaggagaggaaaccaagagtgtagcccagacgtggtttgctacagagattaacatggattgaaaagaaccaggtgcattcctcaagacaatggaagtataatttgagagaccaaaatagatgcccctttatcaactgatatggaccctaagtttaaggaaacaaaagttacctactggttgaggattcangcttgactggcatggtaacttcctaaattccttatggctacaagaagaaccacactcttgctaatctccctaacaacaggagctattaggtagattgtcaaacctttcctaagtgatttacaacccaggccactacaattctgattagacagaggacttgccttacactctttcctgattaacaattgcagacctcaagccagtttcagcaagctcataactgtctttgtgtcctatggtttgtcttttgacaaaaggcaaaaataaagagccaagttctgcctcattttaatgctaaaacctcactccaaaatgaacatgagatgtata

SEQ ID NO: 1285 - DNA, 661 bp, Homo sapiens
  misc_feature [331]..[331]: Chromosome 11, SNP identification no. = rs11032354
  misc_feature [331]..[331]: allele = g, in linkage disequilibrium with rs2278170, respectively
  misc_feature [331]..[331]: n is a, t, c or g
tagacagaggacttgccttacactctttcctgattaacaattgcagacctcaagccagtttcagcaagctcataactgtctttgtgtcctatggtttgtcttttgacaaaaggcaaaaataaagagccaagttctgcctcattttaatgctaaaacctcactccaaaatgaacatgagatgtatattccatatatctttacccactatgcatatgctcaactcccctcataaatatgtattagctttttctccaaacctgctgagtatgtatgactatcgtgtaatacacaccttgtgaagcataaaaaccagtctgcccttttcctcttnagagagagaacctttggtacaagttagagactatcttttcccggtttgcaactaatattgccaataaaattcctctattatttagccattgtggtggtcttttgcatgacagaagaaagaccctgaaggcgtttcaaagatagttgaggctgtcactcctatcataggtccagaagcctagaaggaaaaaatagtttccagagagaggccccaggcaccctccaaaggtttgctacccagggctgtcttgggattctgctccctaatttactctggctcagtgcttctcagctgatccagctatggcccaagcagccccaggtgcaggtc

SEQ ID NO: 1286 - DNA, 661 bp, Homo sapiens
  misc_feature [331]..[331]: Chromosome 11, SNP identification no. = rs11032359
  misc_feature [331]..[331]: allele = c, in linkage disequilibrium with rs2278170, respectively
  misc_feature [331]..[331]: n is a, t, c or g
agaggatacaagccctaagccttggcagtgtccatgtggtgctaatgctgcaggcttgcagaaagcaagagctgtgaagacttggcagtgtccatgtggtgctaatcctgcaggcttgcagaaagcaagagctgtgaagacttggcagtctccatgtagatttcacaggaagttgattacaacgtgggagctggggcagagacttgtggggcagagccactgcacccctgctaagagcccccactagagctgtgctgagtaaaaatgtggggttggagctgctgcagagagttcttaccaggatgatgcctagtgtcatgaaagcaggacnccagaactgtagcgttaccagcagcaggcaatgcctacctgggaaaccctcagaaacctatagaggcagtgttgtgtggagtacacagcaaagccatagggtggggctgcctggggctgccaggaggctttacataaagtgaaaagcaattattgtctagctttaagatgtaatgtctgccctgctgggttttggccttgcctggggcacgttattcctttctttttgcctatttctcccttttggaataagaatgtctgtcttatgtctgtagcatcaatgtatcttggaagtagataacctgttctgatttcacagactcatagatga

SEQ ID NO: 1287 - DNA, 661 bp, Homo sapiens
  misc_feature [331]..[331]: Chromosome 11, SNP identification no. = rs11032361
  misc_feature [331]..[331]: allele = t, in linkage disequilibrium with rs2278170, respectively
  misc_feature [331]..[331]: n is a, t, c or g
ctcagaaacctatagaggcagtgttgtgtggagtacacagcaaagccatagggtggggctgcctggggctgccaggaggctttacataaagtgaaaagcaattattgtctagctttaagatgtaatgtctgccctgctgggttttggccttgcctggggcacgttattcctttctttttgcctatttctcccttttggaataagaatgtctgtcttatgtctgtagcatcaatgtatcttggaagtagataacctgttctgatttcacagactcatagatgagagtctgcactttggacttttgagttggtgctggaatgagttaaaacantggggctatagagatagcatgaatgtatttgtatgtcagaacatgagttttagggggtggggcagggcagaatgctatggtttgaatatttgtccctgccatacaaatctccaatgtggcagtactgagaactggggcctttaaaagcagtgactgggtcacatgggctctgccctcatgtatgaactaatctattcatgaatagattaatggattaacaaaccagcttgttaacattgtggtgggaatggtggctttatgagaagaggaagagagacctgaggtagcacattagcatgctcagctccttgctgtgggatgtcctgtggc

SEQ ID NO: 1288 - DNA, 661 bp, Homo sapiens
  misc_feature [331]..[331]: Chromosome 11, SNP identification no. = rs10768026
  misc_feature [331]..[331]: allele = t, in linkage disequilibrium with rs2278170, respectively
  misc_feature [331]..[331]: n is a, t, c or g
cagaggatgcctgcttcctttctgtgccaaacactgtgggccatctccaagagctcttagctgattattccagtttggatccagtcactgcttttcctaagtcccaccagtgtccccatcccagttaaagggcttctgcattagtcaagaggaagaaaatggggcctgaactagataaatgtcagagaaaggtaaatacatgtttttgaggttcttctaccagaagcagtcttgaagcaccttgcatatgtgactatccttccttgtctggttcttaatttttcaaatctgtcattctgatatccttttaagataaagctgtaggcaaccnaatagatatcagtattaactgagtccattcagcatatggaggcctcttttaaggagttctgggagacataaacagacaagtcctttgagcatggatatcttagttctgaaaacaatgaacagtctggacaaaattttcactacagagcaggtcttagattctggatattaggggaagacgactggctccattcacgctcctactctgagtccttcattctgaaaggagttgattttagatgaccttcaaaggaaataagatttatggacttggacatcctgtcttttccagaaaaatttaagagatgccatccattttctatgtgtgagg

SEQ ID NO: 1289 - DNA, 661 bp, Homo sapiens
  misc_feature [331]..[331]: Chromosome 11, SNP identification no. = rs331502
  misc_feature [331]..[331]: allele = c, in linkage disequilibrium with rs2278170, respectively
  misc_feature [331]..[331]: n is a, t, c or g
aagttcttttcaagaacagtattcccttttttaattttcaagttttctcctactaccggataatttttcaacagaaaaaaacatgttatttctcccttcttaaaaacaaatttacatataaacacacagacatgcaaacacacaaactcttgactctactgttcacttttagccagtgttctatttacttactggcctttacatccaaactcttcaaaggagtgaaccatgttaaaagacttcaattcctctttcagctattctaagtcaagtaacactttaccttcctctattctagcaaaatagtttttatcaaggcatttgatcctcngtgattccaaaagcaggctaatttggttttcaaattctttgactcatcaatagcatttagtataatcttactaaatcagtgataatgtcctcattaacaaactatattcaatagactattaatatagcacatcaccttaaaaatctttctatattaatacttgtccactatcagagttcttttccaacttctccatgggccccaactcctctcctaccccattcttaacattgagattcagtcctaggttcttttctctctgtgaacacttactatctgggtgctgtttatctcttttccacatatatttcaccatcttcacttgaattt

SEQ ID NO: 1290 - DNA, 661 bp, Homo sapiens
  misc_feature [331]..[331]: Chromosome 11, SNP identification no. = rs11032378
  misc_feature [331]..[331]: allele = t, in linkage disequilibrium with rs2278170, respectively
  misc_feature [331]..[331]: n is a, t, c or g
tatatttcaccatcttcacttgaatttctgatagatatctcaaacttaacctgttcaaaattgaagtcttgacctccaccctccataacttccccatcacagttgggagcaactcctttctattagatgtttatgtgaaaaattgggtctcatctttgactctctgttgtctcacatcctatatccagcctgtcaagaatatcactgacattatttttgaaatatatccccaatcccattacttcccactacatacattgctaccttgatcctgagccaatgttctctcccttccctggattcctgcaatagtctccaggcacttttcccnggttctacccttccctatttgtgctattatccatcatggatgccacagaaaactttaaaagtctaagtctcctccctctctgctgaaaacaatgtctttgattctgagagaaatgaggaacctttgcaaagttccacaaaggcctatgaggtcctgtgtgatctggccccagcaccctaacttgattctcctgctcattcacttcatcctagcaggctgcctgctgatcttcgaataccaggtgtttttatgtcttagggcattttctctggctgttccattttcttagactgttcctctcctgtgggagactcctacatcctacattat

SEQ ID NO: 1291 - DNA, 661 bp, Homo sapiens
  misc_feature [331]..[331]: Chromosome 11, SNP identification no. = rs11032381
  misc_feature [331]..[331]: allele = g, in linkage disequilibrium with rs2278170, respectively
  misc_feature [331]..[331]: n is a, t, c or g
aagtcttgacctccaccctccataacttccccatcacagttgggagcaactcctttctattagatgtttatgtgaaaaattgggtctcatctttgactctctgttgtctcacatcctatatccagcctgtcaagaatatcactgacattatttttgaaatatatccccaatcccattacttcccactacatacattgctaccttgatcctgagccaatgttctctcccttccctggattcctgcaatagtctccaggcacttttccccggttctacccttccctatttgtgctattatccatcatggatgccacagaaaactttaaaagtntaagtctcctccctctctgctgaaaacaatgtctttgattctgagagaaatgaggaacctttgcaaagttccacaaaggcctatgaggtcctgtgtgatctggccccagcaccctaacttgattctcctgctcattcacttcatcctagcaggctgcctgctgatcttcgaataccaggtgtttttatgtcttagggcattttctctggctgttccattttcttagactgttcctctcctgtgggagactcctacatcctacattatcttatggctgtctcacgtcctatcatctcccctttttgttgtagccattgctgtgggaaccat

SEQ ID NO: 1292 - DNA, 661 bp, Homo sapiens
  misc_feature [331]..[331]: Chromosome 11, SNP identification no. = rs890416
  misc_feature [331]..[331]: allele = a, in linkage disequilibrium with rs2278170, respectively
  misc_feature [331]..[331]: n is a, t, c or g
cttgggtcgtcccaaggatgtgtgtggaagccagggtgtggaagccagtggataagagttcccctcttctgtgtctagagtggacaattatttggttccttcttaatggttcttcatgtggaactggatacagtgatgactgcattatccagctcgataatgcacctttggatccatattctctttcctgttccactccttcatcctactcttgttcattgtataatttttctatgtataccacttgtctggaattacaggtttggctttttaaagaaacaaagctagtatttcctcacctcatttaatatttgctagaattccctttgcnatgaggcctgcaatgatctctttatttcagatttcaacctcccctgctccctgccatggaattcctatcctcattatccttgatcctttttttggtttgttttttaaaatcacggcagtgaacctttgtatattatgatgtaatttacttactatgtccttttattatccttctccaacctttagcaaaattattctaagggatctgttttgttcatgaattttttcttaatcgaatcagcaaaaatatttacatttttattgtactaaatttgccaaatatatttactgaattttatgtgaacatagcattgaacagaattaaagcttg

SEQ ID NO: 1293 - DNA, 661 bp, Homo sapiens
  misc_feature [331]..[331]: Chromosome 11, SNP identification no. = rs890417
  misc_feature [331]..[331]: allele = a, in linkage disequilibrium with rs2278170, respectively
  misc_feature [331]..[331]: n is a, t, c or g
atccttctccaacctttagcaaaattattctaagggatctgttttgttcatgaattttttcttaatcgaatcagcaaaaatatttacatttttattgtactaaatttgccaaatatatttactgaattttatgtgaacatagcattgaacagaattaaagcttgagacatgcaataattcaatattttgaggtagggctgaagcaggagactgaaagaagcagctcctttgatgggtaatgtaagtattaaggggagccaagaggagaaaaggagtttcagaagaatggtcaattcagaaaaaagctgctgaaagatcaacatgaatgaangcaagtatgtgaccatggcatcatatggaggtcatttctggcccaaatgagcgctttttcaggtagattagaatgtgctaatactacaggaaatttgtgggagttgaatctgaatatgtagacattcctaggtatttttatgcaaagaagagctaaactttgaaaaaatagagaggatataagatcatggaggagaagattataaagtgttaatcgacatagaaaccttttttttttttcttttcaagcataagttttctgtggagggagagacagatgacaaataaggctctaaataataaacgttaggctgggcgcggtgactcacgc

SEQ ID NO: 1294 - DNA, 661 bp, Homo sapiens
  misc_feature [331]..[331]: Chromosome 11, SNP identification no. = rs890418
  misc_feature [331]..[331]: allele = c, in linkage disequilibrium with rs2278170, respectively
  misc_feature [331]..[331]: n is a, t, c or g
ctgaattttatgtgaacatagcattgaacagaattaaagcttgagacatgcaataattcaatattttgaggtagggctgaagcaggagactgaaagaagcagctcctttgatgggtaatgtaagtattaaggggagccaagaggagaaaaggagtttcagaagaatggtcaattcagaaaaaagctgctgaaagatcaacatgaatgaaggcaagtatgtgaccatggcatcatatggaggtcatttctggcccaaatgagcgctttttcaggtagattagaatgtgctaatactacaggaaatttgtgggagttgaatctgaatatgtanacattcctaggtatttttatgcaaagaagagctaaactttgaaaaaatagagaggatataagatcatggaggagaagattataaagtgttaatcgacatagaaaccttttttttttttcttttcaagcataagttttctgtggagggagagacagatgacaaataaggctctaaataataaacgttaggctgggcgcggtgactcacgcctgtagtcccagcactttgggaggccgaggcgggcagatcacgaggtcaggagacggagaccatcctggctaacagggtgaaaccccgtatctactaaaaatacaaaaaattagccgggcg

SEQ ID NO: 1295 - DNA, 661 bp, Homo sapiens
  OR52K3P
  misc_feature [331]..[331]: Chromosome 11, SNP identification no. = rs331503
  misc_feature [331]..[331]: allele = a, in linkage disequilibrium with rs2278170, respectively
  misc_feature [331]..[331]: n is a, t, c or g
cctttgggcatttaggtagaagcaaaaggagatgattatttagaacattaaatttggaaaacgctagaactcaaacttggctgacactattaactatggtgtcttagagatattattttcccaacactcaattttctcattttgaaaaaagaccaataactaagcagttactttgcttactgactgtgctgtctcgatgcattatctcatttaattctcagaagaacttcattaaataaattctaacaagaagaatgcccgggtaaaaactgggcaacttcagtgtttaaggcttttgacagaagaaagaaaaacgagcaagagaggaganaaatattaaaaattgttaagctaaagtttgtgtgtgggggagccagatgttagtctttctaaagatgaaagagttctgtgatgaaaattaaggaaatggaagatggacggagggagacccacatgaacaggaaagttaatgtgagtttagatgaaggaaaaccaaaagagaaggctcttcatcttctcgtaagctgcaggcatagctgtatttttaaagtttttgttaaaagaacctggaagatgtattatagagcagtgccctttaatggagctttctgcaaggatagaaatagtcttgacctaaattgtccaatatagtagccactag

SEQ ID NO: 1296 - DNA, 661 bp, Homo sapiens
  OR52K3P
  misc_feature [331]..[331]: Chromosome 11, SNP identification no. = rs9633905
  misc_feature [331]..[331]: allele = a, in linkage disequilibrium with rs2278170, respectively
  misc_feature [331]..[331]: n is a, t, c or g
tgcttgccatattctggttcagggatcgggagatcaacttttttgcctgtctggtccagatgttcttccttcactccttctccatcatggagtcagcagtgctgctggccatggcctttgaccgctatgtggccatctgcaagccactgcactacaccacggtcctgactgggtccctcatcaccaagattggcatggctgctgtggcccgggctgtgacactaatgactccactccccttcctgctgagatgtttccactactgccgaggcccagtgattgcccgctgctactgtgaacacatggctgtggtcaggctggctgtgggaanactagcttcaacaatatctatggcattgctgtggccatgtttattggagtgttggatctattctttatcatcctatcttatatctttatccttcaggcagttctacaactctcctctcaggaggcccgctacaaagcatttgggacatgtgtctctcacataggtgccatcttagccttctacacaccttcagtcatctcttcagtcatgcaccgtgtggcccgctgtgctgcgccacacgtccacattctcctcgccaatttctatctgctcttcccacccatggtcaatcccatcatctacggcgttaagaccaagcagatccgtgac

SEQ ID NO: 1297 - DNA, 661 bp, Homo sapiens
  OR52K3P
  misc_feature [331]..[331]: Chromosome 11, SNP identification no. = rs2278170
  misc_feature [331]..[331]: allele = c, t
  misc_feature [331]..[331]: n is a, t, c or g
ctccccttcctgctgagatgtttccactactgccgaggcccagtgattgcccgctgctactgtgaacacatggctgtggtcaggctggctgtgggaacactagcttcaacaatatctatggcattgctgtggccatgtttattggagtgttggatctattctttatcatcctatcttatatctttatccttcaggcagttctacaactctcctctcaggaggcccgctacaaagcatttgggacatgtgtctctcacataggtgccatcttagccttctacacaccttcagtcatctcttcagtcatgcaccgtgtggcccgctgtgctgngccacacgtccacattctcctcgccaatttctatctgctcttcccacccatggtcaatcccatcatctacggcgttaagaccaagcagatccgtgacagtcttgggagtattcccgagaaaggatgtgtgaatagagagtgaggaataagtggaaaaagagtggggcacagtgaatgctgtagtgggccagggctgtgctgagagtagatgggtgctagactccacgtttagttcttttcttgtattatggaaagaataaatgatgtcctgaagctcagtgccaacagtctgtttagaatttgtgggtctttgccctctggtagcctctg

SEQ ID NO: 1298 - DNA, 661 bp, Homo sapiens
  OR52K3P
  misc_feature [331]..[331]: Chromosome 11, SNP identification no. = rs2278171
  misc_feature [331]..[331]: allele = t, in linkage disequilibrium with rs2278170, respectively
  misc_feature [331]..[331]: n is a, t, c or g
tggctgtggtcaggctggctgtgggaacactagcttcaacaatatctatggcattgctgtggccatgtttattggagtgttggatctattctttatcatcctatcttatatctttatccttcaggcagttctacaactctcctctcaggaggcccgctacaaagcatttgggacatgtgtctctcacataggtgccatcttagccttctacacaccttcagtcatctcttcagtcatgcaccgtgtggcccgctgtgctgcgccacacgtccacattctcctcgccaatttctatctgctcttcccacccatggtcaatcccatcatctanggcgttaagaccaagcagatccgtgacagtcttgggagtattcccgagaaaggatgtgtgaatagagagtgaggaataagtggaaaaagagtggggcacagtgaatgctgtagtgggccagggctgtgctgagagtagatgggtgctagactccacgtttagttcttttcttgtattatggaaagaataaatgatgtcctgaagctcagtgccaacagtctgtttagaatttgtgggtctttgccctctggtagcctctggattgaacctggtgactgtgctgtctcctcacagagccctgactcctgtcagtaaacttgacagagtctt

SEQ ID NO: 1299 - DNA, 661 bp, Homo sapiens
  OR52K3P
  misc_feature [331]..[331]: Chromosome 11, SNP identification no. = rs2278172
  misc_feature [331]..[331]: allele = t, in linkage disequilibrium with rs2278170, respectively
  misc_feature [331]..[331]: n is a, t, c or g
ctatggcattgctgtggccatgtttattggagtgttggatctattctttatcatcctatcttatatctttatccttcaggcagttctacaactctcctctcaggaggcccgctacaaagcatttgggacatgtgtctctcacataggtgccatcttagccttctacacaccttcagtcatctcttcagtcatgcaccgtgtggcccgctgtgctgcgccacacgtccacattctcctcgccaatttctatctgctcttcccacccatggtcaatcccatcatctacggcgttaagaccaagcagatccgtgacagtcttgggagtattccngagaaaggatgtgtgaatagagagtgaggaataagtggaaaaagagtggggcacagtgaatgctgtagtgggccagggctgtgctgagagtagatgggtgctagactccacgtttagttcttttcttgtattatggaaagaataaatgatgtcctgaagctcagtgccaacagtctgtttagaatttgtgggtctttgccctctggtagcctctggattgaacctggtgactgtgctgtctcctcacagagccctgactcctgtcagtaaacttgacagagtcttgaccctccggcctcatggtgactttgctgaaggacacaaagatgc

SEQ ID NO: 1300 - DNA, 661 bp, Homo sapiens
  OR52K3P
  misc_feature [331]..[331]: Chromosome 11, SNP identification no. = rs2278173
  misc_feature [331]..[331]: allele = a, in linkage disequilibrium with rs2278170, respectively
  misc_feature [331]..[331]: n is a, t, c or g
tctcacataggtgccatcttagccttctacacaccttcagtcatctcttcagtcatgcaccgtgtggcccgctgtgctgcgccacacgtccacattctcctcgccaatttctatctgctcttcccacccatggtcaatcccatcatctacggcgttaagaccaagcagatccgtgacagtcttgggagtattcccgagaaaggatgtgtgaatagagagtgaggaataagtggaaaaagagtggggcacagtgaatgctgtagtgggccagggctgtgctgagagtagatgggtgctagactccacgtttagttcttttcttgtattatgnaaagaataaatgatgtcctgaagctcagtgccaacagtctgtttagaatttgtgggtctttgccctctggtagcctctggattgaacctggtgactgtgctgtctcctcacagagccctgactcctgtcagtaaacttgacagagtcttgaccctccggcctcatggtgactttgctgaaggacacaaagatgcttccaagttcatttgcctaagagaagactgtgaaaatctgaatttccatctctgacttgttggaaatttggtgaattatccactcagattcccgagttaggacctctactccatccagtgcaggagttctgctaca

SEQ ID NO: 1301 - DNA, 661 bp, Homo sapiens
  OR52K3P
  misc_feature [331]..[331]: Chromosome 11, SNP identification no. = rs11032407
  misc_feature [331]..[331]: allele = t, in linkage disequilibrium with rs2278170, respectively
  misc_feature [331]..[331]: n is a, t, c or g
tgtcctgaagctcagtgccaacagtctgtttagaatttgtgggtctttgccctctggtagcctctggattgaacctggtgactgtgctgtctcctcacagagccctgactcctgtcagtaaacttgacagagtcttgaccctccggcctcatggtgactttgctgaaggacacaaagatgcttccaagttcatttgcctaagagaagactgtgaaaatctgaatttccatctctgacttgttggaaatttggtgaattatccactcagattcccgagttaggacctctactccatccagtgcaggagttctgctacattctaacagttganccctagactctacctaaacactgtcagtgctggtgcacatgcatcctttaggcctatttattccaagtgagacagctctgcttgttagaaggttatttcttcaactaagccagtctgtattctttgacttctttttacctcctcatcctcatggctattccatctcattaaatactttgaagaaaaaccatatcctctgacattttattatatatcacataactctttctttgtgcatagacgtatcttatattttcaacaagaatgtgaattgtttacttatttaataatctagccaagtctatgctatctgctagggatacagactgt

SEQ ID NO: 1302 - DNA, 661 bp, Homo sapiens
  misc_feature [331]..[331]: Chromosome 11, SNP identification no. = rs9633900
  misc_feature [331]..[331]: allele = c, in linkage disequilibrium with rs2278170, respectively
  misc_feature [331]..[331]: n is a, t, c or g
cacctctgatgctccctcataccgtgtcttatgagttgaattttgttcccctttccaatttatatgttaaaatcctaacacccagcacttcagaatgtgactgtatttgaggatgaagtctttaaagtaatacttaagttaaaatgcggtgattaggatgggccttaatccaatatgacaggtgtctatataagaagagaaaatttgtacacagacacaggcagagtgaagaccacgtaaagatacagaaagatggccatgtacaagccaagaagagtggcctcggtagcaaccaattctgcttgggtcttggacttctatcttctagaantgtgaagaaataaatttctgtttattaggccccccagtttgtattaccttttatagaagccctagaaaactacttttggcaccagaaagtaaggtgctactgtaactaatacctaaaaatgtggaagttgcttggaaactgagtaatgggctgaagctgaaaaagttttgaggtgcgtgttaaaaaaggctaagatttcttcgaagagattgtaggtagaaatatgaatattaaagatgcttttagtgaggtctcaggaaggaggaactggaagaaagatgatctatgttatcaaatgaaaaagaacttggacaaattgtgttctagtac

SEQ ID NO: 1303 - DNA, 661 bp, Homo sapiens
  misc_feature [331]..[331]: Chromosome 11, SNP identification no. = rs2641405
  misc_feature [331]..[331]: allele = a, in linkage disequilibrium with rs2278170, respectively
  misc_feature [331]..[331]: n is a, t, c or g
tcgagaacatcttgccgtcggaaaactgaagagtcccaatctacaatgatggaccggagtgatatcgggggaataggggcatccataactattccgatacagactgatggagacaagggtacacaagaccggacttctttcggtagtgacgtgatttatcacaaccacaggaacagtagtctagtaaatactaccggaaccacttataacaggagacctaacagagtaacctgtattagaggacctagaagacgggaatatatagataatattatataagggtagggagaagaaggagatggaagaaggtcccgttagattcataaaaacnaaacgactcgtgaccagcagtgatgaagagtccgaatgttctcggtgggatcactttgtctcaaggggccgggggtaacgtcttgtacactgtccccgcaccgagtagacaagctgtcggtacgtgtgaattgtggaatgtcctcccccctcgtacgtcaacccgtccacgtcctggaccacgaggtcggggtgtcgtcgtacggtccccgtccttggatactgaggacttcgagttcacctgcacattgtcatacaataaaataggaacggtagacgtctaccgacttcgtaatttgtcgagtcacctgggagacggaaaaacgttccc

SEQ ID NO: 1304 - DNA, 661 bp, Homo sapiens
  misc_feature [331]..[331]: Chromosome 11, SNP identification no. = rs11032827
  misc_feature [331]..[331]: allele = t, in linkage disequilibrium with rs2278170, respectively
  misc_feature [331]..[331]: n is a, t, c or g
cagttacaatccagcttgattttctccattaggagcttatttttatgttaatcctagttatggatacagaactcaatacttctggctttaaggcttttattctgaactgctcctttctccccttcccaattcttggactcagaacaagtgggaggatataagaaatgtgactaagtgcttgacctttgctgggacaaaactggatagttctgggttcttcgagaaatactcaagttttcacatttatcttaactcaggaaattcagtctttcggtcactcagctgaatttctagttgtgtggatagtttgtgtggaggccccactgtgttncctaaggctactctaccccctactccagagccactcttggcagatgttcattattttatggctcttacctaaaaggaaaatgtcagcccaaaactaaggcttcgagattaggacagttatagctaatggtcttttcccatccttagtgacagtgctgaacttttaattcatacatgagattgaaggaaaccagattatgttaccccaaaatatgcctcaacataagaagtttgaactaaagcaattaagcagcaaacaggagagctctttcctccccactttctgcctaaaaataggctatcagtctacaaaccttactccattatagtt

SEQ ID NO: 1305 - DNA, 661 bp, Homo sapiens
  OR52N1
  misc_feature [331]..[331]: Chromosome 11, SNP identification no. = rs7948009
  misc_feature [331]..[331]: allele = a, in linkage disequilibrium with rs10769224, respectively
  misc_feature [331]..[331]: n is a, t, c or g
tatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcncttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaa

SEQ ID NO: 1306 - DNA, 661 bp, Homo sapiens
  OR52N1
  misc_feature [331]..[331]: Chromosome 11, SNP identification no. = rs10769224
  misc_feature [331]..[331]: allele = c, t
  misc_feature [331]..[331]: n is a, t, c or g
gcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacanagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttagga

SEQ ID NO: 1307 - DNA, 661 bp, Homo sapiens
  OR52N1
  misc_feature [331]..[331]: Chromosome 11, SNP identification no. = rs10742787
  misc_feature [331]..[331]: allele = c, in linkage disequilibrium with rs10769224, respectively
  misc_feature [331]..[331]: n is a, t, c or g
agcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggngaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaaatgacataatgactgttggaagttcattgtatagcag

SEQ ID NO: 1308 - DNA, 661 bp, Homo sapiens
  OR52N1
  misc_feature [331]..[331]: Chromosome 11, SNP identification no. = rs7924824
  misc_feature [331]..[331]: allele = t, in linkage disequilibrium with rs10769224, respectively
  misc_feature [331]..[331]: n is a, t, c or g
acagaatagatgaaaataggcttcacgggtctgaagaagtgggctatatcagccggaatgtgttgattaaaattttttaaaaggagcaagttgtgtgatgggggcatatcccatatagaaggatattggaggaaaactaagtaggctttctaatttaaaaatatcaatattgatatttatagttcctccttgacatattggaggtgacccacctgtcacttcagggatgtcactattgaaaatttaaggttgtataaaactggctatcctattttcatatgtgtcttttataaaatttttatgtccttattttatgaaatattagggctgnataaatgaactcttgtcacttttctaattgagatataattcaaataacattactatcatgtgaaatagaggcaactcactgaaaagaagacaaaacacagaaaagtatggaatgaggctgtcatctctctttttttcagatcacagaaaaaattcttttctctcagaaatgctgcttttagctttcacagccagagggaataaatagaatacttcctgcaaagattgtttcagtaattgaaatgtgaatattttatccaaagtgaaaatggaacatacaagccagtttgtctgctgcaccattttaaaagctaggagaataactcttctg

SEQ ID NO: 1309 - DNA, 661 bp, Homo sapiens
  misc_feature [331]..[331]: Chromosome 11, SNP identification no. = rs10838648
  misc_feature [331]..[331]: allele = t, in linkage disequilibrium with rs10769224, respectively
  misc_feature [331]..[331]: n is a, t, c or g
caaaatgctgggattacaggcatgagccaccgtgtctggctgaaacagccttcttttggaagagcatgtcatcatagagaggataagtcaatgtctgtcttcaaaacttcaaagaacaggctgactatcttgttaggggctaatgcagctggtgactttaagttgaaaccaatgctcatttaccaatccccaaatcctagggcccttaataattattctaactctatgttgtctttgctctctatatagaacatcaaagcctggatgacagtacatacgtttagagcatggtttattgaatattttaagcccactgttgaaacctactgcncaagaaaaatggattcctttcaaaatattcctgctcattgacaatgtgcctggcaactcaagagctgtaatggaaatgtacagggagattaatttattttcaaggctgctcatacaacatccattctgcagcacatggaacaagaagcaattgtgactttcaagtcttatttatttaagaaatacattttgtaagactatagctgccatagatggtaattgttctgatgtgcatgtgtaaagtcaattgaaaaccttctagaaaggattcaccatattagataccattaacaacatttataattcatgggatgaggtcaaaatatcaaca

SEQ ID NO: 1310 - DNA, 661 bp, Homo sapiens
  misc_feature [331]..[331]: Chromosome 11, SNP identification no. = rs10769232
  misc_feature [331]..[331]: allele = g, in linkage disequilibrium with rs10769224, respectively
  misc_feature [331]..[331]: n is a, t, c or g
ttgattcctttccagacatctgtctactttgaggataatttcaatcccagcctttgatgtttccttaaacttgatcaagatgtactaacggggattgcaacagaaaagaatgctatatttctactgaagtaaaggggaacagtgatggagagacagtgcatttaacagtgttaacctttcaaataaagacataactcagccttattgcagaatatatattttaatgagcccctagcataaaacattctgaaattgtttactcaatatttttgagaaagctttaaaatacccacatggcacatgaataaatatataaaatgttatgaaactngaatggaactgccctagggagtcaggtaaaattccaggtttatgattcaatagatgctagacacttcacatgtcccatcaataataaaatttgagatttttttctgtcaggcatagacatattctaattatagatctattttcaacaaaggtaaattcacctccttttcagagacctatgggacatctatctgtaaagccccaaagaatttttttaccttggcttggaaaatccccagagaagatattaagtttgttacatagggttcctcatcaatattgtgcaattatttctaagtaatatcagtcatgaatgggaatttaaaaacat

SEQ ID NO: 1311 - DNA, 661 bp, Homo sapiens
  misc_feature [331]..[331]: Chromosome 11, SNP identification no. = rs7949986
  misc_feature [331]..[331]: allele = a, in linkage disequilibrium with rs10769224, respectively
  misc_feature [331]..[331]: n is a, t, c or g
ggcacatgaataaatatataaaatgttatgaaactggaatggaactgccctagggagtcaggtaaaattccaggtttatgattcaatagatgctagacacttcacatgtcccatcaataataaaatttgagatttttttctgtcaggcatagacatattctaattatagatctattttcaacaaaggtaaattcacctccttttcagagacctatgggacatctatctgtaaagccccaaagaatttttttaccttggcttggaaaatccccagagaagatattaagtttgttacatagggttcctcatcaatattgtgcaattatttctnagtaatatcagtcatgaatgggaatttaaaaacatctggcaccagggtgagtttggatgaaaatggttcagataaaaagaaaacaaatatataaaatgcacaaaattgctactatataggagggatttaaatgagagagcagttgaataaggaagttctgaattacttcactctttagaattttgaaaccaaggaatttgcaaattgccttgaggagggagaagagggagaaaattaaatgtagtttaggtcctgaaggaaggggattccatgaggctgatgtgacaaggaccaaagagatataggcaagcatatttctatacaataata

SEQ ID NO: 1312 - DNA, 661 bp, Homo sapiens
  OR52N3P
  misc_feature [331]..[331]: Chromosome 11, SNP identification no. = rs1377512
  misc_feature [331]..[331]: allele = a, in linkage disequilibrium with rs10769224, respectively
  misc_feature [331]..[331]: n is a, t, c or g
gagatgttttattcacttttattttaatataggtcggtagggaattttggaggacctatgaaggcagaatgagtctcgtttgtggttgtaggaatataaacaaatgttttaggatgtgttaatcccgagaaaatttatagacttacatagagggtcataagattaagagtaagagagtcaggtaggtatggatgacttcaaaagagttcgaattgtttgtacatgttaatttctataaagatgaacgtcatagttacggacgatacaagtagggttcgacatattacttgcctacctacttatttaagattttagaggaaaaacctaccangaggacgaatatgtatttatggaattgtttaatcacagtgttatttgaaactttttatttttgcataatccttctgtactaaagttcaaagttctacaggaattagaatagatgtttttaatttttaattactttagcctctataaatcttaacccttctcatgtacatcatctacgtacgtttaacagaaaacataataaaacgtataggggttttatttgtataatatttatctttttacaatgtctttacatttaaaccgaaactccttacaacgggtaagtgtgtctattttaaaagattattctattaccctagtgacggtagac

SEQ ID NO: 1313 - DNA, 661 bp, Homo sapiens
  OR52N3P
  misc_feature [331]..[331]: Chromosome 11, SNP identification no. = rs7940926
  misc_feature [331]..[331]: allele = a, in linkage disequilibrium with rs10769224, respectively
  misc_feature [331]..[331]: n is a, t, c or g
tgtttttattctgttggttcagttacagtcataggaccattcaatagaatcaaaaaacatagtttggatacaaaatgattattttttcctaaatttattatttagattgtgaaaaatgcgtttttatatttttttctctggatgaaaataatctcactactctctccttatacaggacaactttattggcacaaaaactagcatgttttgtaattggtgagcatcatgaatggagccaacagctccagcctgacaccaagatatttcattctcagtggcgttcctgggctggaagctgcacacatctggatctccctgcctttctgcttcntgtacatcattgttgttttggggaactgtggacttatatacctcattagccatgaggaggccctgcaccaacccacctactacttcctagacttgctgtctcttacagatgttactggatgcacctcatttgttcccaatatgttatgtattttttggtttggcctcaaggaaattgactttaatgcctgccttgtgcagatgtttttcatccacatgctgacaggcatggagtctggggcgctcatgcttatggctctagaccgctatgtggccatttgctaccctctacactattccaccatcttcaccaacactgtaattaccaaag

SEQ ID NO: 1314 - DNA, 661 bp, Homo sapiens
  OR52N3P
  misc_feature [331]..[331]: Chromosome 11, SNP identification no. = rs10769235
  misc_feature [331]..[331]: allele = g, in linkage disequilibrium with rs10769224, respectively
  misc_feature [331]..[331]: n is a, t, c or g
tccgtgctgtagtgaatttgtcatctgcagatgctgccacaaagccttcagtacctgtacagcacatatatgtgctattttcatcacttatgtcccagcctttttcaacttcttcactcaccgctttgggggacacaccatacctcatcatgttcacatttttatagccaacctttacctgatgctgcctcccaccttaaatccaattgtctatggagtgaagaccaagcagatccgtgaaggagtgatcaaattgttttttagagagaaaggtattttaagtatgacataaatctatgatatagaagtctgaatcagcataaagataaanttatagaggaagagaataaatgtaagattcaaaaactatgaactcaggaaaaaatgtgaatattctgccataaattttattaaataatcacaaaatgtttaattcaagacttcaatgtgataaaagacataaaatagacaagacataattatacattttacaaaacttaactttagttagacctgtcgaatggactgaatctcaaatgtcctgttatcctttctagtctatatttatgtgaaacttgtataactttagagaaaaacatctttgcctgctcatttatctctgacatcctgctgcctgggtaagtatttggatttatatgaa

SEQ ID NO: 1315 - DNA, 661 bp, Homo sapiens
  OR52N3P
  misc_feature [331]..[331]: Chromosome 11, SNP identification no. = rs10769236
  misc_feature [331]..[331]: allele = g, in linkage disequilibrium with rs10769224, respectively
  misc_feature [331]..[331]: n is a, t, c or g
aatttgtcatctgcagatgctgccacaaagccttcagtacctgtacagcacatatatgtgctattttcatcacttatgtcccagcctttttcaacttcttcactcaccgctttgggggacacaccatacctcatcatgttcacatttttatagccaacctttacctgatgctgcctcccaccttaaatccaattgtctatggagtgaagaccaagcagatccgtgaaggagtgatcaaattgttttttagagagaaaggtattttaagtatgacataaatctatgatatagaagtctgaatcagcataaagataaagttatagaggaaganaataaatgtaagattcaaaaactatgaactcaggaaaaaatgtgaatattctgccataaattttattaaataatcacaaaatgtttaattcaagacttcaatgtgataaaagacataaaatagacaagacataattatacattttacaaaacttaactttagttagacctgtcgaatggactgaatctcaaatgtcctgttatcctttctagtctatatttatgtgaaacttgtataactttagagaaaaacatctttgcctgctcatttatctctgacatcctgctgcctgggtaagtatttggatttatatgaatgctccagtgcaca

SEQ ID NO: 1316 - DNA, 661 bp, Homo sapiens
  misc_feature [331]..[331]: Chromosome 11, SNP identification no. = rs4758099
  misc_feature [331]..[331]: allele = t, in linkage disequilibrium with rs10769224, respectively
  misc_feature [331]..[331]: n is a, t, c or g
gtctatatttatgtgaaacttgtataactttagagaaaaacatctttgcctgctcatttatctctgacatcctgctgcctgggtaagtatttggatttatatgaatgctccagtgcacacaaaaatgaagctgcaataaatgtggttactagagtgataacgattggggaaatactctttgcagttaatgtcaagaacaattttgaaagattcaatggatactacttgagagttgtttgaggacaggagagatgtagaggaaagaagacttgaagaaatctatatactttgccaatcaaagatgtctgggcttgactgactgatctgagtntcatgtagatggagaagcagcagagtggtcaaggacaatggagaaagtagtacagttggccctccttatatgtgggttctgcaccctgggattcaaccagctgcagatcaaaaatacttggaaaaaaataatacaaccataaaaatgatagaaacaaataatacaatataacaactgtttacatagaattcacattgcattaggtatcataagtaatctagaaatgatttaaaatacacaaaaggatgtgtgtaggttatataaaaacaccacaccattttatataaaggacttgatcatccacagattttattatgggtcgtgtcctgt

SEQ ID NO: 1317 - DNA, 661 bp, Homo sapiens
  misc_feature [331]..[331]: Chromosome 11, SNP identification no. = rs4758100
  misc_feature [331]..[331]: allele = a, in linkage disequilibrium with rs10769224, respectively
  misc_feature [331]..[331]: n is a, t, c or g
ctgctcatttatctctgacatcctgctgcctgggtaagtatttggatttatatgaatgctccagtgcacacaaaaatgaagctgcaataaatgtggttactagagtgataacgattggggaaatactctttgcagttaatgtcaagaacaattttgaaagattcaatggatactacttgagagttgtttgaggacaggagagatgtagaggaaagaagacttgaagaaatctatatactttgccaatcaaagatgtctgggcttgactgactgatctgagtttcatgtagatggagaagcagcagagtggtcaaggacaatggagaaagtngtacagttggccctccttatatgtgggttctgcaccctgggattcaaccagctgcagatcaaaaatacttggaaaaaaataatacaaccataaaaatgatagaaacaaataatacaatataacaactgtttacatagaattcacattgcattaggtatcataagtaatctagaaatgatttaaaatacacaaaaggatgtgtgtaggttatataaaaacaccacaccattttatataaaggacttgatcatccacagattttattatgggtcgtgtcctgtaaccactccctcatgaatactgtgggaacactatactttatttagattt

SEQ ID NO: 1318 - DNA, 661 bp, Homo sapiens
  misc_feature [331]..[331]: Chromosome 11, SNP identification no. = rs4758101
  misc_feature [331]..[331]: allele = t, in linkage disequilibrium with rs10769224, respectively
  misc_feature [331]..[331]: n is a, t, c or g
tactagagtgataacgattggggaaatactctttgcagttaatgtcaagaacaattttgaaagattcaatggatactacttgagagttgtttgaggacaggagagatgtagaggaaagaagacttgaagaaatctatatactttgccaatcaaagatgtctgggcttgactgactgatctgagtttcatgtagatggagaagcagcagagtggtcaaggacaatggagaaagtagtacagttggccctccttatatgtgggttctgcaccctgggattcaaccagctgcagatcaaaaatacttggaaaaaaataatacaaccataaaaangatagaaacaaataatacaatataacaactgtttacatagaattcacattgcattaggtatcataagtaatctagaaatgatttaaaatacacaaaaggatgtgtgtaggttatataaaaacaccacaccattttatataaaggacttgatcatccacagattttattatgggtcgtgtcctgtaaccactccctcatgaatactgtgggaacactatactttatttagatttctggaaatagcagagataaagtgcatggtagtattagaaggataaatgtatttagtaatagcaagattgaattaaacgtgagaaaaatattaagaac

SEQ ID NO: 1319 - DNA, 661 bp, Homo sapiens
  misc_feature [331]..[331]: Chromosome 11, SNP identification no. = rs7484069
  misc_feature [331]..[331]: allele = g, in linkage disequilibrium with rs10769224, respectively
  misc_feature [331]..[331]: n is a, t, c or g
tctgagtttcatgtagatggagaagcagcagagtggtcaaggacaatggagaaagtagtacagttggccctccttatatgtgggttctgcaccctgggattcaaccagctgcagatcaaaaatacttggaaaaaaataatacaaccataaaaatgatagaaacaaataatacaatataacaactgtttacatagaattcacattgcattaggtatcataagtaatctagaaatgatttaaaatacacaaaaggatgtgtgtaggttatataaaaacaccacaccattttatataaaggacttgatcatccacagattttattatgggtcgngtcctgtaaccactccctcatgaatactgtgggaacactatactttatttagatttctggaaatagcagagataaagtgcatggtagtattagaaggataaatgtatttagtaatagcaagattgaattaaacgtgagaaaaatattaagaacataatccaagagaaaattgaagtaatagactgtgatcacaaaataaatataaatggataagcaggtcaagatgttatattgatgaaaattatattcttatttgctaatataaatgatatattttaatatcatgttatatatagtcaaatagcaaaatagtaaaatagattaatcaca

SEQ ID NO: 1320 - DNA, 661 bp, Homo sapiens
  misc_feature [331]..[331]: Chromosome 11, SNP identification no. = rs11039085
  misc_feature [331]..[331]: allele = c, in linkage disequilibrium with rs10769224, respectively
  misc_feature [331]..[331]: n is a, t, c or g
caactgtttacatagaattcacattgcattaggtatcataagtaatctagaaatgatttaaaatacacaaaaggatgtgtgtaggttatataaaaacaccacaccattttatataaaggacttgatcatccacagattttattatgggtcgtgtcctgtaaccactccctcatgaatactgtgggaacactatactttatttagatttctggaaatagcagagataaagtgcatggtagtattagaaggataaatgtatttagtaatagcaagattgaattaaacgtgagaaaaatattaagaacataatccaagagaaaattgaagtaanagactgtgatcacaaaataaatataaatggataagcaggtcaagatgttatattgatgaaaattatattcttatttgctaatataaatgatatattttaatatcatgttatatatagtcaaatagcaaaatagtaaaatagattaatcacaccatatatttttgcaataagattttcatatctgggagtaaaacctgagttttattttttaaaaaagctaaaattatgaagtgtctctatgtaatgtaaatcataagcttatcaatagtaaagtttttatatctcagaattaggttttttcatttggtaaagtttgtttatcaggtaact

SEQ ID NO: 1321 - DNA, 661 bp, Homo sapiens
  misc_feature [331]..[331]: Chromosome 11, SNP identification no. = rs7937133
  misc_feature [331]..[331]: allele = g, in linkage disequilibrium with rs10769224, respectively
  misc_feature [331]..[331]: n is a, t, c or g
tctgcattacataaatgaagaatataaggtacacaagtggaaagactggatgaatcttagaatattacaattaaaatttgaaaacaataatgttaatagacctatgctggggttgggggaagaaacaacagcaagagcaacaaagtaaaacaagaatatatccttaaaatctggataagtaaaatgcaataaataagatgtatttgaggcaatgagtaacaatcgcaaattaattttgttatcttcatcattacaaattcaaaagtatgtttcatgaaaagaaaaaagactctgaaaactaagactcaaaattgaattacagccagcaggncaatatctttgagaaatttcaaaaagaagtataagtttgatggccatagaacaaaattctacttagtattcatgggagaagagacagagagatagatagaggtagacatagagatagagatggagatagagataaagatagagatagagacagagatgatagagatagagagagatgggagagagagacagacagacagatagggaagagggaaggaaataaaagggaagcagggggaaaccaagaggactgggaaagatagtggaaaacattttattttaagttgcatcttgtgccctagagaccaagtgttgggtggcagagatcagc

SEQ ID NO: 1322 - DNA, 661 bp, Homo sapiens
  misc_feature [331]..[331]: Chromosome 11, SNP identification no. = rs1453419
  misc_feature [331]..[331]: allele = c, in linkage disequilibrium with rs10769224, respectively
  misc_feature [331]..[331]: n is a, t, c or g
tataaaaaccgaattaaaacggtcaaatcattttgtgctttgtattgacaatcatctctaaacactcgtcttcgtcaaggacaccttataaacgacataaaacacaggagggtggacataacaataaaacgaggtaaaagaaatagagacgtgtacaccgggtagactttactaactggttcaccaagacctctaagacatttttgttctattagaaggaatatgaaacatagtgaaacagtaaaagaaaaagaaggaaaggaaacccttataattatatagagaatctcaaacttttcctttgtaccaaattgtttaactttagagttanactcaagaaactatggaaccaagatctagattacattgacacacttcaactacatctttataaccccagacaaagtctttcggacgactagagacggtgggttgtgaaccagagatcccgtgttctacgttgaattttattttacaaaaggtgatagaaagggtcaggagaaccaaagggggacgaagggaaaataaaggaagggagaagggatagacagacagacagagagagagggtagagagagatagagatagtagagacagagatagagatagaaatagagatagaggtagagatagagatacagatggagatagatagagagac

SEQ ID NO: 1323 - DNA, 661 bp, Homo sapiens
  misc_feature [331]..[331]: Chromosome 11, SNP identification no. = rs1453418
  misc_feature [331]..[331]: allele = a, in linkage disequilibrium with rs10769224, respectively
  misc_feature [331]..[331]: n is a, t, c or g
ctttcgtgtaaacagtaattaaactttctctgtcttgagtccctttctcactctattctataatcaatataaaaaccgaattaaaacggtcaaatcattttgtgctttgtattgacaatcatctctaaacactcgtcttcgtcaaggacaccttataaacgacataaaacacaggagggtggacataacaataaaacgaggtaaaagaaatagagacgtgtacaccgggtagactttactaactggttcaccaagacctctaagacatttttgttctattagaaggaatatgaaacatagtgaaacagtaaaagaaaaagaaggaaagganacccttataattatatagagaatctcaaacttttcctttgtaccaaattgtttaactttagagttacactcaagaaactatggaaccaagatctagattacattgacacacttcaactacatctttataaccccagacaaagtctttcggacgactagagacggtgggttgtgaaccagagatcccgtgttctacgttgaattttattttacaaaaggtgatagaaagggtcaggagaaccaaagggggacgaagggaaaataaaggaagggagaagggatagacagacagacagagagagagggtagagagagatagagatagtagaga

SEQ ID NO: 1324 - DNA, 661 bp, Homo sapiens
  misc_feature [331]..[331]: Chromosome 11, SNP identification no. = rs1453417
  misc_feature [331]..[331]: allele = g, in linkage disequilibrium with rs10769224, respectively
  misc_feature [331]..[331]: n is a, t, c or g
tcgatatagatatcaaaaaaaattaaattccctttcgtgtaaacagtaattaaactttctctgtcttgagtccctttctcactctattctataatcaatataaaaaccgaattaaaacggtcaaatcattttgtgctttgtattgacaatcatctctaaacactcgtcttcgtcaaggacaccttataaacgacataaaacacaggagggtggacataacaataaaacgaggtaaaagaaatagagacgtgtacaccgggtagactttactaactggttcaccaagacctctaagacatttttgttctattagaaggaatatgaaacatantgaaacagtaaaagaaaaagaaggaaaggaaacccttataattatatagagaatctcaaacttttcctttgtaccaaattgtttaactttagagttacactcaagaaactatggaaccaagatctagattacattgacacacttcaactacatctttataaccccagacaaagtctttcggacgactagagacggtgggttgtgaaccagagatcccgtgttctacgttgaattttattttacaaaaggtgatagaaagggtcaggagaaccaaagggggacgaagggaaaataaaggaagggagaagggatagacagacagacagagag

SEQ ID NO: 1325 - DNA, 661 bp, Homo sapiens
  misc_feature [331]..[331]: Chromosome 11, SNP identification no. = rs11039096
  misc_feature [331]..[331]: allele = g, in linkage disequilibrium with rs10769224, respectively
  misc_feature [331]..[331]: n is a, t, c or g
tacattagatctagaaccaaggtatcaaagaactcacattgagatttcaatttgttaaaccatgtttccttttcaaactctaagagatatattaatattcccaaaggaaaggaagaaaaagaaaatgacaaagtgatacaaagtataaggaagattatcttgtttttacagaatctccagaaccacttggtcaatcatttcagatgggccacatgtgcagagataaagaaaatggagcaaaataacaatacaggtgggaggacacaaaatacagcaaatattccacaggaactgcttctgctcacaaatctctactaacagttatgtttcntgttttactaaactggcaaaattaagccaaaaatataactaatatcttatctcactctttccctgagttctgtctctttcaaattaatgacaaatgtgctttcccttaaattaaaaaaaactatagatatagcttgttgttgggtataaaaatattctgggaataaatgctcggtgccacaaagtgaaacccgcactcaggcaaaagttatcttagcaaggcaatttacttctgcagaagggtgccactcacatcaatcaagatcacaagagcacagggaacaaaggagagcagcgaagttctctctctaatggtagtttctacttctgt

SEQ ID NO: 1326 - DNA, 661 bp, Homo sapiens
  misc_feature [331]..[331]: Chromosome 11, SNP identification no. = rs10742793
  misc_feature [331]..[331]: allele = t, in linkage disequilibrium with rs10769224, respectively
  misc_feature [331]..[331]: n is a, t, c or g
tacaattccccccttttaattttcttatgattctttctcttcaaacgtttttaacatgtcttggctttgccattcgatttgatcttctaaaaggaaaagcttacttgaataaggtggaggagaactaagggaggctttagtaagtgctgtttgtacagtcctttgtattagcctatggatgcgtggtatgacataacacctaacaagaaagagtacacttattacaattgcaagagaaataagaattaaggctatgattcttttccgtttactgaactactttcttagccatcctgaaatagggtcagtgactagaatttttagctagttnattggataaagtggtaagtctttgtaaggccttttttatgctcctatcgggggcagtgttgtttgggattaaggtaaaacattgggttttaatcataacacaaacctcacctttttggctaataacatgtctagtgctattctgttttcttaagctctttggttagtaggctttaattggtcagctattcctttgatggcatccctggtgtaattaataaactgctgctgattataatggatgtaatttatctaagctacatttttattaatagttacttgtggaaatatggattcaaattctgcagctatttggtctcgggctttgaac

SEQ ID NO: 1327 - DNA, 661 bp, Homo sapiens
  misc_feature [331]..[331]: Chromosome 11, SNP identification no. = rs11039102
  misc_feature [331]..[331]: allele = c, in linkage disequilibrium with rs10769224, respectively
  misc_feature [331]..[331]: n is a, t, c or g
tggcatgatttgttgccttaggctgtggaatcttggaaaacagctactatacagcccatgtctggtcgactgagggactatcctagcggaaaggagacaatctgggcctctggtctgctgtgcacacaagaataacaattgcttttattcaaagtgcggacagaatattgaatccatcccaactaagcatttatatcttgataccttgtttcaattgctagagtttgtcttagatccttcacttctacaatatttactttggcattgttgttgggcagggtagaaagtttagaaggtgaaggagggtcaataaagcgtattttaaagaggnctacagggtcgtatccattggcctctgcccctaagccgtaaaagccttctaaaggaagcgtatggttggtagaggtagcagcattaatagagatagttactgggttacaatggtaaagttggcaattagagggggtggttcatttggtaaggaggaggtaagattttaggttggtacagccttctggggaggtctcgccgtgttcattggcagtcaggatgacatctgctcattgagaacgtatctcctaacttaaggtgccttggtacccccaccatgagcaaggtgtgaggtcagtggtttctctgaaggggcagaggtgtttttcta

SEQ ID NO: 1328 - DNA, 661 bp, Homo sapiens
  misc_feature [331]..[331]: Chromosome 11, SNP identification no. = rs12279684
  misc_feature [331]..[331]: allele = c, in linkage disequilibrium with rs10769224, respectively
  misc_feature [331]..[331]: n is a, t, c or g
gtcgactgagggactatcctagcggaaaggagacaatctgggcctctggtctgctgtgcacacaagaataacaattgcttttattcaaagtgcggacagaatattgaatccatcccaactaagcatttatatcttgataccttgtttcaattgctagagtttgtcttagatccttcacttctacaatatttactttggcattgttgttgggcagggtagaaagtttagaaggtgaaggagggtcaataaagcgtattttaaagaggcctacagggtcgtatccattggcctctgcccctaagccgtaaaagccttctaaaggaagcgtatngttggtagaggtagcagcattaatagagatagttactgggttacaatggtaaagttggcaattagagggggtggttcatttggtaaggaggaggtaagattttaggttggtacagccttctggggaggtctcgccgtgttcattggcagtcaggatgacatctgctcattgagaacgtatctcctaacttaaggtgccttggtacccccaccatgagcaaggtgtgaggtcagtggtttctctgaaggggcagaggtgtttttctaaaggagagacatacctttgccattgttcgtcctcttcacaaggcataacaaggcaagcctcaaa

SEQ ID NO: 1329 - DNA, 661 bp, Homo sapiens
  misc_feature [331]..[331]: Chromosome 11, SNP identification no. = rs11607346
  misc_feature [331]..[331]: allele = c, in linkage disequilibrium with rs10769224, respectively
  misc_feature [331]..[331]: n is a, t, c or g
gataccttgtttcaattgctagagtttgtcttagatccttcacttctacaatatttactttggcattgttgttgggcagggtagaaagtttagaaggtgaaggagggtcaataaagcgtattttaaagaggcctacagggtcgtatccattggcctctgcccctaagccgtaaaagccttctaaaggaagcgtatggttggtagaggtagcagcattaatagagatagttactgggttacaatggtaaagttggcaattagagggggtggttcatttggtaaggaggaggtaagattttaggttggtacagccttctggggaggtctcgcngtgttcattggcagtcaggatgacatctgctcattgagaacgtatctcctaacttaaggtgccttggtacccccaccatgagcaaggtgtgaggtcagtggtttctctgaaggggcagaggtgtttttctaaaggagagacatacctttgccattgttcgtcctcttcacaaggcataacaaggcaagcctcaaaggtaatgatttgggatgagtctgacttagttacattgataataaggtcagcaatagaatgaggaaagaagaaagggtaatagaatagataaaagagagttaaactttccttaactttagtttgaggggttttttc

SEQ ID NO: 1330 - DNA, 661 bp, Homo sapiens
  misc_feature [331]..[331]: Chromosome 11, SNP identification no. = rs6578689
  misc_feature [331]..[331]: allele = g, in linkage disequilibrium with rs10769224, respectively
  misc_feature [331]..[331]: n is a, t, c or g
caaggcataacaaggcaagcctcaaaggtaatgatttgggatgagtctgacttagttacattgataataaggtcagcaatagaatgaggaaagaagaaagggtaatagaatagataaaagagagttaaactttccttaactttagtttgaggggttttttcccttgaataatggtccatgactttggggatggtggtgctttcttgactcgggtatgatgggtccatcttttcttgctgtttggactgcagtttcagtggtttgaagcactaggccagctcctcaggctggtgtcaatatactgggaactttaggggtggcacctgtaccngaaaattttgagttctgagggaagagaaagtggaagataaaccaagtatgtaggaatgttggcagtagattgttttgggaggtagtttggacttactagggtaataggaagatagaagacatttcatctatggcaaccaagtctctagacttgtttggctaagggtataaattcctaaacacatataaactttgactgtgttatacatcgcttggggtctttaatgggtaatgtttttctgagttccctttagtgcctacaggagaaacagcagcctgttcggcttatctgatttgctaggttattttaaaagacaggcttttctggtgc

SEQ ID NO: 1331 - DNA, 661 bp, Homo sapiens
  misc_feature [331]..[331]: Chromosome 11, SNP identification no. = rs1453415
  misc_feature [331]..[331]: allele = g, in linkage disequilibrium with rs10769224, respectively
  misc_feature [331]..[331]: n is a, t, c or g
atttattattttcgggtcaaagagttcttcttgacctgatacgagaaaaaacctccgtttctggacaggagggaaagggaatacgtggacggggatgacacctctgtcacttcctcccaagagtctcctaggatcgtttcttttgtcgtgtatcctaagggacctggtaggaaatggattacggggatcagggggtagattatgggggttgggaaggggagtccgggtcggattcaggaggagacactttccttaggttcgaggagtaagcggtccaccgaaaactgtccgatcgctgtagttcctagacggagttgtacaacagcaacancacgtcggagatcacgcgggggtgtcgtctttttcgggtacgagacggcgtcggatacggattcgtctgatgtaataccctgtatacggaatgaaaacggtcccagttcattatgtccgaagtctacgccgaggttcgtcgatccgtaggggcgccgattcaaaggacttgttcatcatctattagaaagtcgactatataggcgatcgtaaataatacccagtccggtcataattttcacttttataggtggtcttttctgaaactaataaatttcagtgaatataattttacatggtggtcttttcataatgtacacatattcatgct

SEQ ID NO: 1332 - DNA, 661 bp, Homo sapiens
  misc_feature [331]..[331]: Chromosome 11, SNP identification no. = rs1840175
  misc_feature [331]..[331]: allele = t, in linkage disequilibrium with rs10769224, respectively
  misc_feature [331]..[331]: n is a, t, c or g
agtcaatgctaaggtcacttcctatccgttctccaggggattgtgttccccaactcggtgttccttagggagcggtttatccgctctttagggattatactaccccaactcggtgtcgttacggggcaatccgttctttaaggattatactctctaacgcggatcggttctgggttataccctttataatgttcgtttttaccattcttatcattgtttctatatatggtggactatcaggggattcagagtactttttcctatacttatcattgtttctatatggtggactatcaggggattcagagtacgattttacaacccttctatnactttcttgatttgtattctttttcgttgtttactattttataacgaaaagataaacctgagtttctggattggagttaggcagttagaagaccggtttcaaacccagttgactcctatatgatacagttgaaagtcaaattgtacatttattattttcgggtcaaagagttcttcttgacctgatacgagaaaaaacctccgtttctggacaggagggaaagggaatacgtggacggggatgacacctctgtcacttcctcccaagagtctcctaggatcgtttcttttgtcgtgtatcctaagggacctggtaggaaatggattacgg

SEQ ID NO: 1333 - DNA, 661 bp, Homo sapiens
  misc_feature [331]..[331]: Chromosome 11, SNP identification no. = rs4372479
  misc_feature [331]..[331]: allele = t, in linkage disequilibrium with rs10769224, respectively
  misc_feature [331]..[331]: n is a, t, c or g
aaaacagtgtggcactagcacaaagtcagaactgcagaccaatgaagtagaacagagagcccagagtgaaccctcacatatgtggtaaagttacttttgacaagagtgtcaatatcattcaatgttgaaaggacattctttacaataaatagtgctgagaaaactgggtatctacatgtacagaaatgaagttggactgttacataacagcatgtccaaatattaactcaaaatggatcaaagacgtaaaaataaaacctaaaattatgaaactcttggaagaaaacaaagagaaaaaattttatgacattggatttggtaatgatttctnggaaatgacactaaaggcacaggcacaggaaacaaaagaaaaaaacagataaattagactttatgaaatttgtttttaaattgtgcatcaaaagattctataaacaaagtaaaaaggcaacccacagaccagaagaaaatatttataaattatatatctgataggtattaatatccaaaatatatatagagctcctaaacctcaacaacaacaacaaacagcttaataagaaatgggcaaaggattagaatagacatttctccaaagaagatatacaaatggataataaacacataaaagacactggacatcagtaatcattagggaact

SEQ ID NO: 1334 - DNA, 661 bp, Homo sapiens
  OR52N2
  misc_feature [331]..[331]: Chromosome 11, SNP identification no. = rs10734554
  misc_feature [331]..[331]: allele = g, in linkage disequilibrium with rs10769224, respectively
  misc_feature [331]..[331]: n is a, t, c or g
caaaatttcataaaagatgtgaataaaatggtattaaaatcatgacatgtaatttacccatgtaacaaacttgcacgtgtacctaaaataaaaatagaaataaaaaatcaaaataaagacataaatttgtaagtcaccataatatgtcaattttctgaagtctctgcaagttcttgaatttgtgtgtgttgggagtgggggcaaggatctgccaaagcagagaatgcaaaataaagaagtaatatacccattacttaaagagttgatgcttttcctaagcgtttatagactcacatgtttgtgagaccagaaaggtagtaaaataaggacngcagacctgctgacaatccctgcgttgcgtgtaagtggggaggctgtagagacatagagaaacgtgggtccagtgttcactatttttcagtattttttaaagacaagctagatttatatgttctatgaaatctccccattttaattgtcagcaaaatatgtgttaaaataccctataattcacagaagaatgtccaagggttctgtttttcccaagtcatcagtttagggtctccatttaaaatggatctaaatgggaacaatagactccaggttcttcgaaaggagcgggaagaataaacactgaaaagctttctgttggatactacat

SEQ ID NO: 1335 - DNA, 661 bp, Homo sapiens
  misc_feature [331]..[331]: Chromosome 11, SNP identification no. = rs7938541
  misc_feature [331]..[331]: allele = a, in linkage disequilibrium with rs10769224, respectively
  misc_feature [331]..[331]: n is a, t, c or g
actcatcaattcattttttgaaacactaatttaagcaatattattagtcatatcttagatttattgagagggaggcagatgatacggttcctggtttcaagatactcagaatctggactgtagccagggatgtgtgagaagaaatacatataaaagaaaggggagagagaaaaaatgaatgcagtgtgaaggaaataaaaagtttgtaggaaagaattgggggaaatataacatcagtttcagattcaattcatctcaagtgttaagtcctctgtcttttaatttctagccactagagttggacaggctacataatctctctaaattttgncttccatattttcttccaaatgtgaaaaagaaaatgtatcacagagatgtttcttctaattaaatgctctgatgcaaaaaaagcttgtagcacaatctctgatgtatactaaccattcaataaattttagttatttttatgagctattagtttcaactctgattcattatgaaaatcatagtttgaggataaatctttccagttgtacaggcagtgcacagtgcagtatcagttttgtgtggacaagctttcttttcttttttttttttgagatggggtctcactctgtcactcaggttaggctgcagtggcatcatctcggctcactgc

SEQ ID NO: 1336 - DNA, 661 bp, Homo sapiens
  misc_feature [331]..[331]: Chromosome 11, SNP identification no. = rs4758444
  misc_feature [331]..[331]: allele = g, in linkage disequilibrium with rs10769224, respectively
  misc_feature [331]..[331]: n is a, t, c or g
ctggacaaagtgacagattttttttcagaaaatggcttattagaatatgaagggctgccattgaggcaggaagatagggtctggaggcagggaacataaggctgatccacacttcagctatagaggaaataccctctccatagggcatacactgagtaaatgactttgtaactttacttgatcctcttcatttacatacagtgtaccccaactagtgggtatttaaactcacaaaaactctgtaacagggcctttgagcctctatgctcaggctgcttctacactgtggagtgtaccttcattttcaataaatcccttcatgccttccttnctttgtttgtgcattttgtccaattctttgttcaagacgccaagaacctggacaccctccactgttaacatcaaattctgaaagtgccacatggtattacacaaatgtacatagtcataagactaaacatttctgcattttctaactcatcctaacaaatgacttctacaaaagccacgaagacaaattagaggagttaaatactttatattgcaacctctgagtttcttcccgctatgaacagaagcataatttcttgctcagtgatgaccacatcaaagatttataccttgaacaccatatttaaaagtgtacctagtgctcccaagt

SEQ ID NO: 1337 - DNA, 661 bp, Homo sapiens
  misc_feature [331]..[331]: Chromosome 11, SNP identification no. = rs1979197
  misc_feature [331]..[331]: allele = g, in linkage disequilibrium with rs10769224, respectively
  misc_feature [331]..[331]: n is a, t, c or g
caagaacctggacaccctccactgttaacatcaaattctgaaagtgccacatggtattacacaaatgtacatagtcataagactaaacatttctgcattttctaactcatcctaacaaatgacttctacaaaagccacgaagacaaattagaggagttaaatactttatattgcaacctctgagtttcttcccgctatgaacagaagcataatttcttgctcagtgatgaccacatcaaagatttataccttgaacaccatatttaaaagtgtacctagtgctcccaagtttttcttactctcatatttttatagagcacattcatttctnaatcattataaaattttatatatttattatgttaactgttattggatgtcctctccaatcatgctctttaaattattagtaccacaaggccagggacactggttcgtgcctgtaatcccagcactttgggaggccgaggtgggtggatcacttgaggccagagttcaagaccagcctggccaacatgtattttagtctctactaaaaatacaaaaattagctgggcatggtggcacatgcctctaatcccagtgatatggtttggctgtgtccctctggaaatctcatcttaaattgtaacttccacaattcccacatgtcatgggagga

SEQ ID NO: 1338 - DNA, 661 bp, Homo sapiens
  misc_feature [331]..[331]: Chromosome 11, SNP identification no. = rs11601828
  misc_feature [331]..[331]: allele = c, in linkage disequilibrium with rs890248, respectively
  misc_feature [331]..[331]: n is a, t, c or g
aggcagaatttcaaaggctgtgctatgaaaaacattgttgcccctgacatttctgggccccattgtgaaagggacgcttggagaggatgaagccagtgcatggactgcttagaggccagcagcttggaggctgtgttctgaggaggtgaaggtagaaatgaacacatattgaatgcctacaatgagtcaggctgtgctggggttttttggtttttgttttttgaatctgaggaaatggaaaatgaaagaagttccccctttaggtgctgggccccaacaggttcagggtactggatgaacagagagggcaaaagcagggcatgtccacacnagagctgagaaggggcagagaggaggggtttctccaggggcagtgcactggagagccagctacatggccaggaaggctgtgcatggtgccagcagctgcatggccaaaggttcgccacacacagaaatggggttattctggattggggaagggacactggcaggggcattcacagcaggctgaattagcaactgggaggcagaaacgtgtgtaggcaggagcactggggttagaggcgcaaggaaggatggctcccctccttagtgaaggagagaaacaagaaagcagcatgcagcaagaatacttcaccctattccactttctctcatc

SEQ ID NO: 1339 - DNA, 661 bp, Homo sapiens
  misc_feature [331]..[331]: Chromosome 11, SNP identification no. = rs11037302
  misc_feature [331]..[331]: allele = g, in linkage disequilibrium with rs890248, respectively
  misc_feature [331]..[331]: n is a, t, c or g
gaataaggttattggaatcagccttgattccaccctgtttaagaagaagtttaataaaagacagataagcctggtgtttagattgtcattgtcccataataaccctggaataataccggtcgacaaacctgaaaagaggggagagtcggaaaaagagtacccagagaccttaccgtcaagactgaagactagtcgtcatgaacctgcactcagagtgcactgagctgagaaacaaagaaggccatgttgggcgccagatattgcgggatctggctagcagcctgcaatgcaacagggctctttctttgtccccaggtggatcagcagatcnagaaacaatagacacacacaagatagtgaaagctgggtccggggggtcaccacctcctggtcccatggtgctgccaatgcactggatgtagcagcattcattattaagtttagtgagggtgggggtaggttagtgagggatttagggttgtttgattatgaggtgagatggtcacatggggatgaagtaattctttaacataacatctgtatgcagaagtacagtatacagagataaggatttacagtatagtgtgtgcatcagtaatttctaacagagccttaaaacagaaacacagtctttccatagcctatgattagcaagatatta

SEQ ID NO: 1340 - DNA, 661 bp, Homo sapiens
  misc_feature [331]..[331]: Chromosome 11, SNP identification no. = rs7940185
  misc_feature [331]..[331]: allele = g, in linkage disequilibrium with rs890248, respectively
  misc_feature [331]..[331]: n is a, t, c or g
ggatgatatttctctcaatttctcagagggtgtacaccacccctgtgatattgttcccaatatccatggggtgagaggatgatattagtctcaatatcgcaggaggtgtacacttcctagtgatattgttcctaatatctagggactgagagaatgatattattcccaatatagcagtgggcgtacaccccttctgtgacattgttcctaatagccagcgggggagaggaagatattactttcaatatcgcagggcatatacacccaattgtgatattgttccttatatcccgggagggagacaatgatacgagtggcaatatcgcaggcnctgtacacacccactgtgatattgttttgattatccagaggggaagaaaatgatattactcccaatatcacagggggtgtacatcctcctgtgataattgtttcttatattcaggggggagaggataatattactcccaatattgcaggggttgtacacacctcctgcaatattttccctaatatcctgaagggaagagcataatatgactctcaatatcgcagggggtgtatacctcctttgtaatattgttcttaatatccatgatggcagaggacgatattactcccaatatcacaataagtgtacagcctcctgtgatacagttcc

SEQ ID NO: 1341 - DNA, 661 bp, Homo sapiens
  misc_feature [331]..[331]: Chromosome 11, SNP identification no. = rs6485403
  misc_feature [331]..[331]: allele = c, in linkage disequilibrium with rs890248, respectively
  misc_feature [331]..[331]: n is a, t, c or g
ttctccttccactcatgagaccccagcagtctagaagagaacgctgctcacttctgagcacccactatagttgggcttatggacagatacaggttgaagtttatatcatttcagataccattttttagaaagaaagctacaaatttctgaatacaaagtagacttggtgccttgaaagagatggtttctggcacaagcccctgtggtcaggcattttccatatgccatcccagaccataagaattggactctaattctgactctagcgcctactagctgatggaaaaataacctctcagggcctcagttttctcctctataaaatctatcnttaggtaaagaattatcattagtaaggcaaagaggctcacacagggctgcactgaggcttggatttaggtttccaatcttaatagacagaccatccacctggtaacacaatctttcatcatctctgcattccaagagaggaccactgctacaaaacaaacaagagtttgaagccaccgagactatgaccctcaacctttctttgcatgaggccacctggaaagctttaaaaatataacagtgacaaacccctccccacaggttctgatttaattgctctgggtgtaatgcccaggcattggctttttttttaactctccaggtgatttta

SEQ ID NO: 1342 - DNA, 661 bp, Homo sapiens
  misc_feature [331]..[331]: Chromosome 11, SNP identification no. = rs2114089
  misc_feature [331]..[331]: allele = g, in linkage disequilibrium with rs890248, respectively
  misc_feature [331]..[331]: n is a, t, c or g
catatgggtttacgagaaggagtatgagggaactttgggaacgacttcgacctacaaccctagacgtaaacccttcccagtgtagatcccggtcaactcatctctttgtaccgacggagtatggtccacgtacgcccctcggtccctctccttccaggagttccgttctctcgacatcttaaaatggggaggtcttatttctctccacctactgacttacaaacggagaatgaaaaagtggacgacctacttagtaagaacgaggacactcctcttcggttactttgacatctcttgttgtctaagacggttaatgtgggttcaccacaanataaccgactgttttagtatccctctctctcgtataccgaaagtgatgtcagagactagaacgaaaaaattttaaataacgggagagaactaaactgtacacctcttaatgttaaactccaagtctcttcaattactaaactttcagtgtgaagtcactgattgggtccggatctgaggtcggacagtttccctcaaatctcgagttcttcagtctgggaagtctaatatttacccggttcacgaactgtctctatcgtatactgaacagattctggtttaacggttttgatctttgagtccagaagactgaggaagactacgagaaaaa

SEQ ID NO: 1343 - DNA, 661 bp, Homo sapiens
  misc_feature [331]..[331]: Chromosome 11, SNP identification no. = rs7931762
  misc_feature [331]..[331]: allele = g, in linkage disequilibrium with rs890248, respectively
  misc_feature [331]..[331]: n is a, t, c or g
ccttcagccgaattcactcctttcaagaagatgctcaagatggttttgttgttcagtttgttttttggtaaagggagaggaaagtacaaaagaacccatcaaacatggaaatcaaagccagagtgaagctgtgaactgtaaggcacaaggcaagaggaagggtagcatggcggttaaatatcagctttggaaccaagaaggctgagcctgaatcctcactctacactgactgtgtggccctgggcaatttgtttaattttccagggggtctctgttttctcagccataaaatgaagataacagtagtatctcttttctccagtggttgtgnagactctgtaagatactatgcatccagcatcaagtgaagtgcctagaacatgttactcattcatttagctactctttgaattttcaattagccacttactaatagttgggtaatatgcctgtcctttctgagcttcaatttcctttttgaaaagcagaaaaaataaaatgtctaccttgaatggttgtcataagaactggaaaaagaccaacattatacctagcacttagaaggtacttcacaaagaaagctattatttaagtgatcataaaactttaaggaaatttagtatgtcttcatcaggaaacattttagaatgggctttttaaa

SEQ ID NO: 1344 - DNA, 661 bp, Homo sapiens
  misc_feature [331]..[331]: Chromosome 11, SNP identification no. = rs1559763
  misc_feature [331]..[331]: allele = t, in linkage disequilibrium with rs890248, respectively
  misc_feature [331]..[331]: n is a, t, c or g
atttaacctatttacgtgtcggtgtgacccctcccgttataactcagaggcttaagtatacgattagaaacggtctctgtgagagtgtttgtgtgggtcttttattacgaattagacccgtgggacaccgtatcagatcaactgtacattttaattagtagtgtcaatatgtcctcgaattctttgtgataaaatttctcactaagaaatgaccgacttttaaaccttttcaactgggtattttagttctaactccttacccgatccctaaaacagatcaagtgggtttattttaaaacgactcacagattacatagtccgtgaccctcanatttctacttttctctgtgtcaaagaagagaacttgtcgaacaacagctcatcttctaaaatttttcgggtaagattttacaaaggactacttctgtatgatttaaaggaatttcaaaatactagtgaatttattatcgaaagaaacacttcatggaagattcacgatccatattacaaccagaaaaaggtcaagaatactgttggtaagttccatctgtaaaataaaaaagacgaaaagtttttcctttaacttcgagtctttcctgtccgtataatgggttgataatcattcaccgattaacttttaagtttctcatcgatttactta

SEQ ID NO: 1345 - DNA, 661 bp, Homo sapiens
  misc_feature [331]..[331]: Chromosome 11, SNP identification no. = rs1025168
  misc_feature [331]..[331]: allele = t, in linkage disequilibrium with rs890248, respectively
  misc_feature [331]..[331]: n is a, t, c or g
agagactacccaccaaaggaaatctactggaaatattatgagtatactgaaacagtaaggtactaaaacactcaggactcctgtcactcgtacgtactcgagtatctcactggtcctttcttagaaaactccaacttcctacttccttccttgtctatatcctacctttttccctccgtcctccctcgatacccgtttcccacgtgacactcgaattacttttcagacccaaaaaaaaggaacaggtatatagcgttctactttggtggaatagagattagcgtaaatctcatgtgtgtgtgtgtgtgtgtgtgtgtgtctgtgtgtgtanctaaatagtactccttaaacgagtgtactccgactcttcagggtattagacggtagatgttcgatgtcctatcagtcacatcagtcaccacattagggtaagactcagacttccggactcttgatcctcccagatagtgtatctagggtcaggtacccatgctcttctggttattgggtcgaatttgtccgtctgttcttcactttccccacttaaacaaaggaaggaggaaaaacaggataagttcggaagttatttaacctatttacgtgtcggtgtgacccctcccgttataactcagaggcttaagtatacgattagaaacggtct

SEQ ID NO: 1346 - DNA, 661 bp, Homo sapiens
  misc_feature [331]..[331]: Chromosome 11, SNP identification no. = rs1353463
  misc_feature [331]..[331]: allele = g, in linkage disequilibrium with rs890248, respectively
  misc_feature [331]..[331]: n is a, t, c or g
ggttaaagttttattaggttcgtttgtcgttaatccctatataagatgaagaagggtaaacaagtatcgaggcgtcctgtattacactagagggtacgtataacactccctttacctgtcgtgaatctaaaaaggaatgaaactacacactgacagtcccaacgtttattacacggacgttttcttttaacggaggaccaagtggacttctaccttaaaattttttacaaagaagaaggaaggaaaagagaaagataaatgagtcgtaatgcactcaaccgacaattcgtggacttgtctccttctttaacaaatatccacggggttaccntactcagatctgattctcttttgtcggttgtatcgtttcttcacaaatgtcgtaaataatccatacataaataattcgtggacaacccgtgtttcttgtactttgtacctctgacgaacaatcgccgaaaattagaccaacacccctatcctatatgtacgtgttactcaattcaacttctaaacactataactttcctctcagtcgagtatgacactcggacgttttctgtttcgatgtttgtccctgacccatcttcgatgtctctctatccagacccaatttacattcaaagattgtctcgactggttgctattcaaccttccggat

SEQ ID NO: 1347 - DNA, 661 bp, Homo sapiens
  misc_feature [331]..[331]: Chromosome 11, SNP identification no. = rs890249
  misc_feature [331]..[331]: allele = g, in linkage disequilibrium with rs890248, respectively
  misc_feature [331]..[331]: n is a, t, c or g
ctggaacgaaagatcacaccaacatcgaccgtagaaaaaagaatttagaccccgaaatcaagtttgactctgttatccttttgacggtaaaattataagagaaggtttcactatactagtctacagataataaacgtattataactacttatgtcagaggttagtgtaatgaaggggttgggagtatgttttgtttgttttacgaatagggagaatataattttttagtcttataaaatatttagaccggtcaaaacgtaaagaaacggaatctgtcataatttaatcagtttgttaaggaagaagttatgagatgtccttcacaccccgngaaatagaagaaaccaaattttttttcgagttggtcgacagtttgtgaacttatacttggtctgtaaatttataagtcacttttaagtttacataacatatttcgcgagtcgtttcacctttcgggagactggttaaagttttattaggttcgtttgtcgttaatccctatataagatgaagaagggtaaacaagtatcgaggcgtcctgtattacactagagggtacgtataacactccctttacctgtcgtgaatctaaaaaggaatgaaactacacactgacagtcccaacgtttattacacggacgttttcttttaacggaggacc

SEQ ID NO: 1348 - DNA, 661 bp, Homo sapiens
  misc_feature [331]..[331]: Chromosome 11, SNP identification no. = rs890248
  misc_feature [331]..[331]: allele = t, g
  misc_feature [331]..[331]: n is a, t, c or g
atccgaccggtctgagaacataaacctaaagaaaaatccgtacgaagtcaaatggtagaaacaaaagagtgttcaaggttcgaaaggttcataaagaggacttcgaggggtacttgaaccctgacggtgtcttaggtggcttccaaagggttagtgaggagttaaccgactaactcggataacccaattctaaacgttctgaacaaaacctaatataagaaacgtatggatcctggaacgaaagatcacaccaacatcgaccgtagaaaaaagaatttagaccccgaaatcaagtttgactctgttatccttttgacggtaaaattataanagaaggtttcactatactagtctacagataataaacgtattataactacttatgtcagaggttagtgtaatgaaggggttgggagtatgttttgtttgttttacgaatagggagaatataattttttagtcttataaaatatttagaccggtcaaaacgtaaagaaacggaatctgtcataatttaatcagtttgttaaggaagaagttatgagatgtccttcacaccccgagaaatagaagaaaccaaattttttttcgagttggtcgacagtttgtgaacttatacttggtctgtaaatttataagtcacttttaagtttacataaca

SEQ ID NO: 1349 - DNA, 661 bp, Homo sapiens
  misc_feature [331]..[331]: Chromosome 11, SNP identification no. = rs890246
  misc_feature [331]..[331]: allele = t, in linkage disequilibrium with rs890248, respectively
  misc_feature [331]..[331]: n is a, t, c or g
taatcaaaacaaggagatctcttgggactgattatatgtggagtttaccaataaaacctactttagggaaatttccttcgaatcccaaccacctccgtagtccgtttgacatcctcctccgtacgagggagaaagtagtttgaagttctcacgttgagaaaggttttgtcggagtgagaagtgagacggtaatccgaccggtctgagaacataaacctaaagaaaaatccgtacgaagtcaaatggtagaaacaaaagagtgttcaaggttcgaaaggttcataaagaggacttcgaggggtacttgaaccctgacggtgtcttaggtggnttccaaagggttagtgaggagttaaccgactaactcggataacccaattctaaacgttctgaacaaaacctaatataagaaacgtatggatcctggaacgaaagatcacaccaacatcgaccgtagaaaaaagaatttagaccccgaaatcaagtttgactctgttatccttttgacggtaaaattataagagaaggtttcactatactagtctacagataataaacgtattataactacttatgtcagaggttagtgtaatgaaggggttgggagtatgttttgtttgttttacgaatagggagaatataattttttagtcttataaaa

SEQ ID NO: 1350 - DNA, 661 bp, Homo sapiens
  misc_feature [331]..[331]: Chromosome 11, SNP identification no. = rs7935140
  misc_feature [331]..[331]: allele = a, in linkage disequilibrium with rs890248, respectively
  misc_feature [331]..[331]: n is a, t, c or g
tctttccagatgaggacagccccatcctttcctggcctccaaccctggaggagccagagatagcacggttagtgggcaagggagaggagaaaagcaatatgaagaagtagatgaccatgctccttccttgatgtaagctcaaagcctgcctcaggcctgagctaagggaagaaaataatttcataatcagatgaaaacgtgaagttgatattagactgaactagacatttataactgaaaaaaagagatagaacatttatatccaagatggatgagaaaggcaatgctacctagccaaatctcatttggaatcttggaaaaaatgactcantggagcaagtttaacagaaactggtgagaaagaaaagttgctttctgctcgtgaccaccaccaagttcagggggggaaatgtgttacttacaagtgtcttgctttaaaaaacaaataaataaaattaaaattaaaaactacatgattgattttaagataatcaaatcctcacaaggcatgtgtttgcatatcaggtccctgccaatcttgtgaactccatctcaagctaacccccacctacacccacacaataactccagccaggtagatttctggaagcttctcaaaatataagctgcttatcacctcaggcacatacttttccctttg

SEQ ID NO: 1351 - DNA, 661 bp, Homo sapiens
  misc_feature [331]..[331]: Chromosome 11, SNP identification no. = rs7938445
  misc_feature [331]..[331]: allele = a, in linkage disequilibrium with rs890248, respectively
  misc_feature [331]..[331]: n is a, t, c or g
agttgctttctgctcgtgaccaccaccaagttcagggggggaaatgtgttacttacaagtgtcttgctttaaaaaacaaataaataaaattaaaattaaaaactacatgattgattttaagataatcaaatcctcacaaggcatgtgtttgcatatcaggtccctgccaatcttgtgaactccatctcaagctaacccccacctacacccacacaataactccagccaggtagatttctggaagcttctcaaaatataagctgcttatcacctcaggcacatacttttccctttgcctttgaattgcttgcctcttctcatcctcacatgnctaatttctccttattcttggagtgcttataggcaacagaaactagcagaaacaagcagaaagtgaattcattggaagggtagagggtagctcacacaaacaaatactaaagaaacaattcatttaaaacacagctggaaaagaacaaaagccaagggagtccaaggaattaagatggaaggaaatgatggacaagctcttccagagggtgaatcatcttcagctgttttcattttgcttgttcacaggagaagagtcagtgctaggctgggacataggctcacccctgactaggagagggctgagtacttgcacacaatgcagaagcaa

SEQ ID NO: 1352 - DNA, 661 bp, Homo sapiens
  misc_feature [331]..[331]: Chromosome 11, SNP identification no. = rs977439
  misc_feature [331]..[331]: allele = g, in linkage disequilibrium with rs890248, respectively
  misc_feature [331]..[331]: n is a, t, c or g
caaggaagaacctccgagatcccctcttaaccgaaggaacggaaaaagatcgatgaccttcgacggacgtaaggaaccggacactgaggaagaagtgtagtaaggttgaagaacgaaaactgtagagtaacggaagagaagaagacatagtttagaggaagatgaaggaaaagtatttctgtaaacactaatgtaaatccctggtgagtctgttaggtcctattggaggggtagcgttctagaaattgaatcagtatggaagtttcaggaaaaagagtaaattccattacaagggtccaaggtccttaatcctggacttatagaaaccccnggtaacagtcagatgccatgagacgatactggatacgtaacctttgtatatgttcaaccttttctactgataaaggagacgggaatatctcggttactctatatgtgtcaatttttaatatgtttatgtatatatgtatgtgtcggatcaccctatctgtggaaatgtgtttattaagacttcaagtgaatacgactcacaagtttcctctttacattctaccctattcttttatattgtctaactggaccgttccactagtatcttttaaaaggcttttctattattgtctattatgaaggacacatgttatcaacacgagtcacccaa

SEQ ID NO: 1353 - DNA, 661 bp, Homo sapiens
  misc_feature [331]..[331]: Chromosome 11, SNP identification no. = rs977438
  misc_feature [331]..[331]: allele = t, in linkage disequilibrium with rs890248, respectively
  misc_feature [331]..[331]: n is a, t, c or g
cgaagaaaaacggcaaacgtttcagagtatataaataagtcgtttataaagaatacacggatacataatcaaggaataccgacaacattatttaatggtgtttgaatcatcgaattttgttgtgtctaaataaggacatatttagacctccagttttcaggtcttagtcaaattgacccgattgtggtgccacggtcgtcccgaccaaggaagaacctccgagatcccctcttaaccgaaggaacggaaaaagatcgatgaccttcgacggacgtaaggaaccggacactgaggaagaagtgtagtaaggttgaagaacgaaaactgtagngtaacggaagagaagaagacatagtttagaggaagatgaaggaaaagtatttctgtaaacactaatgtaaatccctggtgagtctgttaggtcctattggaggggtagcgttctagaaattgaatcagtatggaagtttcaggaaaaagagtaaattccattacaagggtccaaggtccttaatcctggacttatagaaaccccaggtaacagtcagatgccatgagacgatactggatacgtaacctttgtatatgttcaaccttttctactgataaaggagacgggaatatctcggttactctatatgtgtcaatttttaatatgttt

SEQ ID NO: 1354 - DNA, 661 bp, Homo sapiens
  misc_feature [331]..[331]: Chromosome 11, SNP identification no. = rs7943295
  misc_feature [331]..[331]: allele = t, in linkage disequilibrium with rs890248, respectively
  misc_feature [331]..[331]: n is a, t, c or g
gactttgcaaacggcaaaaagaagccaagcatgatggctcatgcctgtaatcccagcactttgagaggccaaggcgggcagacagcttgagctcaggagtttgagaccagcctgggaaacatgacaaaaccctgtctctaccaaaaatacaaaaaattagctgggcatggtggcatacacatgtggttccagctactcgggaagctgaggtgggaggaatacttgagcctggaagtttcaagtgagctgctatcgcaccattgccctccaacctggcctacagatgagaccccatctcaaaaaataaaataaagaatagcaaaacgagtgnaaataaaaaccagcatggaagctgaagtatgagaagtcttcatgatgtagataactctgagcaatttattttggtccacacctctcaaatgtcatgataggtggatcagttaaatactgcacatccctgtgtttgtcaaagctcttagttgcaagctgaaggagttaccactggctgatttaagcaggcaaaaggaatttattgaaaatattgtgtttatttcagattcaccaggataactgaagtactagtttcaagcctagccatgcaccttgttcattgcaacatgacagccctgtagaagtcatgcagtcagaagaaacatactaa

SEQ ID NO: 1355 - DNA, 661 bp, Homo sapiens
  misc_feature [331]..[331]: Chromosome 11, SNP identification no. = rs2068405
  misc_feature [331]..[331]: allele = a, in linkage disequilibrium with rs890248, respectively
  misc_feature [331]..[331]: n is a, t, c or g
aaattaaatctttaactcctcctgtataaattggagttatcgaagttataaaacaatggacgaaattaagcttaaattttcactaacctgtgtcttccagtaatcgatgtactcatgcgtaagattaaaacccttaagtaccacttaaggtcacgaactttcattcaaatgacattcgaaacctataccttaccatcttaggtaaatagaaaggcaacaccaaggagtagtggacttagaaaaaaagccaccccttagaggggacgggagtaaaacgtagaacaatccacgaactctacggagaataatgtttgtgatttttacaggtcangaatgaaaggatctgaaggaacatcaaatcctgagaactccttgagaggtcgacgtcacgacgtccctctactctttgacgtcattgttaccaccgtcggtcataacccacggtcgacccgaacactacgttacgacacaaaccacgtcacggttaccacagaaggggtctggttaacacgtcgtacaaatcatacaaagaagactgacgtactgaagatgtcccgacagtacaacgttacttgttccacgtaccgatccgaactttgatcatgaagtcaataggaccacttagactttatttgtgttataaaagttatttaaggaaaac

SEQ ID NO: 1356 - DNA, 661 bp, Homo sapiens
  misc_feature [331]..[331]: Chromosome 11, SNP identification no. = rs7933421
  misc_feature [331]..[331]: allele = g, in linkage disequilibrium with rs890248, respectively
  misc_feature [331]..[331]: n is a, t, c or g
acatactaaacatgctgcacaattggtctggggaagacaccattggcactgcaccaaacacagcattgcatcacaagcccagctggcacccaatactggctgccaccattgttactgcagtttctcatctccctgcagcactgcagctggagagttcctcaagagtcctaaactacaaggaagtctaggaaagtaaggactggacatttttagtgtttgtaataagaggcatctcaagcacctaacaagatgcaaaatgagggcaggggagattccccaccgaaaaaaagattcaggtgatgaggaaccacaacggaaagataaatggatnctaccattccatatccaaagcttacagtaaacttactttcaagcactggaattcaccatgaattcccaaaattagaatgcgtactcatgtagctaatgaccttctgtgtccaatcacttttaaattcgaattaaagcaggtaacaaaatattgaagctattgaggttaaatatgtcctcctcaatttctaaattaaatgaaaacatcttgaggaatttttaatgatgaatttccttactcagattgccaaatgacatgatcaacagagaaaagcctggttttgtttctccatcacactgccctattagattgaattagagccatattaac

SEQ ID NO: 1357 - DNA, 661 bp, Homo sapiens
  misc_feature [331]..[331]: Chromosome 11, SNP identification no. = rs959648
  misc_feature [331]..[331]: allele = t, in linkage disequilibrium with rs890248, respectively
  misc_feature [331]..[331]: n is a, t, c or g
atcactgtaaaatatagatgggtttgagatcaataaactaacgaaggtttattctaatagaaaatggtaaaactgttcatcaattataccgagattaagttagattatcccgtcacactacctctttgttttggtccgaaaagagacaactagtacagtaaaccgttagactcattcctttaagtagtaatttttaaggagttctacaaaagtaaattaaatctttaactcctcctgtataaattggagttatcgaagttataaaacaatggacgaaattaagcttaaattttcactaacctgtgtcttccagtaatcgatgtactcatgngtaagattaaaacccttaagtaccacttaaggtcacgaactttcattcaaatgacattcgaaacctataccttaccatcttaggtaaatagaaaggcaacaccaaggagtagtggacttagaaaaaaagccaccccttagaggggacgggagtaaaacgtagaacaatccacgaactctacggagaataatgtttgtgatttttacaggtcaggaatgaaaggatctgaaggaacatcaaatcctgagaactccttgagaggtcgacgtcacgacgtccctctactctttgacgtcattgttaccaccgtcggtcataacccacggtcga

SEQ ID NO: 1358 - DNA, 661 bp, Homo sapiens
  misc_feature [331]..[331]: Chromosome 11, SNP identification no. = rs959647
  misc_feature [331]..[331]: allele = c, in linkage disequilibrium with rs890248, respectively
  misc_feature [331]..[331]: n is a, t, c or g
atacctttttccgttttataatcaacttaccgataaaattcatcgtctgaaactatcgggttccagatcctaaaggtatgaaggaaataatatcactgtaaaatatagatgggtttgagatcaataaactaacgaaggtttattctaatagaaaatggtaaaactgttcatcaattataccgagattaagttagattatcccgtcacactacctctttgttttggtccgaaaagagacaactagtacagtaaaccgttagactcattcctttaagtagtaatttttaaggagttctacaaaagtaaattaaatctttaactcctcctgtanaaattggagttatcgaagttataaaacaatggacgaaattaagcttaaattttcactaacctgtgtcttccagtaatcgatgtactcatgcgtaagattaaaacccttaagtaccacttaaggtcacgaactttcattcaaatgacattcgaaacctataccttaccatcttaggtaaatagaaaggcaacaccaaggagtagtggacttagaaaaaaagccaccccttagaggggacgggagtaaaacgtagaacaatccacgaactctacggagaataatgtttgtgatttttacaggtcaggaatgaaaggatctgaaggaacatca

SEQ ID NO: 1359 - DNA, 661 bp, Homo sapiens
  misc_feature [331]..[331]: Chromosome 11, SNP identification no. = rs10838055
  misc_feature [331]..[331]: allele = c, in linkage disequilibrium with rs890248, respectively
  misc_feature [331]..[331]: n is a, t, c or g
gccaaatgacatgatcaacagagaaaagcctggttttgtttctccatcacactgccctattagattgaattagagccatattaactacttgtcaaaatggtaaaagataatcttatttggaagcaatcaaataactagagtttgggtagatataaaatgtcactataataaaggaagtatggaaatcctagaccttgggctatcaaagtctgctacttaaaatagccattcaactaatattttgcctttttccatatcagaaaactggctaatcactgggaatttttttttcctgcttaagaaggaattcctgaaggaatgtatattctanggagggttgaaaggatactgatatgtaaaaaatgattataataattataagatatagcgggtgccctaacagatgtgttatggtttgaattgtattccacccaagattcatgtgctgaaattctaactcctggtgcttcagaatgtgaccttatttggaagtaggaccatagcagatgtcactaattaaattaaaatgagatcttactgaagtagagttggcctctaatccagttgactgtcatccttataaaaagaatgtcatgtgaagagacaggcatgcacatgggaagaatgctatgtgaaggtttgagttatactgcaacaagcc

SEQ ID NO: 1360 - DNA, 661 bp, Homo sapiens
  misc_feature [331]..[331]: Chromosome 11, SNP identification no. = rs10838056
  misc_feature [331]..[331]: allele = t, in linkage disequilibrium with rs890248, respectively
  misc_feature [331]..[331]: n is a, t, c or g
attcctgaaggaatgtatattctatggagggttgaaaggatactgatatgtaaaaaatgattataataattataagatatagcgggtgccctaacagatgtgttatggtttgaattgtattccacccaagattcatgtgctgaaattctaactcctggtgcttcagaatgtgaccttatttggaagtaggaccatagcagatgtcactaattaaattaaaatgagatcttactgaagtagagttggcctctaatccagttgactgtcatccttataaaaagaatgtcatgtgaagagacaggcatgcacatgggaagaatgctatgtgaangtttgagttatactgcaacaagccgagaaacttccagaagttaggacagaggcctagaacagatccttccccatcatctttagagagatcatggccctgccaatacctgatcttggactgctagaactgtgagaaaatacattcctcttgttctaaatcactcagtgtgtgatacttgttaatggtagccttagaaaactgatacaagatgtatgggtcaagtgttctgtgaccacatgggagggacagattcattatggctgaggatctgaaaaaagtgacctcagggaaggtgccatcagttgcatatatggaaaagcgaaaaggatt

SEQ ID NO: 1361 - DNA, 661 bp, Homo sapiens
  misc_feature [331]..[331]: Chromosome 11, SNP identification no. = rs7129867
  misc_feature [331]..[331]: allele = c, in linkage disequilibrium with rs890248, respectively
  misc_feature [331]..[331]: n is a, t, c or g
actcctggtgcttcagaatgtgaccttatttggaagtaggaccatagcagatgtcactaattaaattaaaatgagatcttactgaagtagagttggcctctaatccagttgactgtcatccttataaaaagaatgtcatgtgaagagacaggcatgcacatgggaagaatgctatgtgaaggtttgagttatactgcaacaagccgagaaacttccagaagttaggacagaggcctagaacagatccttccccatcatctttagagagatcatggccctgccaatacctgatcttggactgctagaactgtgagaaaatacattcctcttnttctaaatcactcagtgtgtgatacttgttaatggtagccttagaaaactgatacaagatgtatgggtcaagtgttctgtgaccacatgggagggacagattcattatggctgaggatctgaaaaaagtgacctcagggaaggtgccatcagttgcatatatggaaaagcgaaaaggatttcaactggcagggaaaatataggttaagaaaggagcgttatattagtctgtcctcacactgctatagagatactacctgagactgggtaatttatgaaggaaagaggtttaattgattcacaactctgcatggctggggaggcctcagga

SEQ ID NO: 1362 - DNA, 661 bp, Homo sapiens
  misc_feature [331]..[331]: Chromosome 11, SNP identification no. = rs7950242
  misc_feature [331]..[331]: allele = t, in linkage disequilibrium with rs890248, respectively
  misc_feature [331]..[331]: n is a, t, c or g
gtgaatatgatgaaattttattctttattgatagctctttcctatatttgtctctgaaattttctgaactttaaatcctcttcaaaatttaaatttaaaaagtataagagttcacttgtcttacaattgctaatctaggtggagggctcaagatagtttagtttgggaattgtcaacatctatgaagggtctgagatgcttaccctacttgtaagttaaccagatagactgccacagtctcatgtatgccaacagaaggtgtgtgacttctgggtcagaaacaaaagactttattactcaatggcaacagcagtggccagggtgtcagcanttgtgtcagtttcccaacttccagggcaatacaaagaaggttgtattacagaagaggaacactgggtttatggaacctaaatcttttctaatgggtggtaagactgcttggtctatgctctggacactgttttccaaagtcataagccaatctgccattgctccagagggagacaccatatctatcttccaaggctggttgtgacataagcatccttggaaatatagcctaagacaaagtgagccaattccttgctcataaagtcttcagaaattcaagggaccaatggagaattatctctgaacagaaatttttcaatatgtgaagatt

SEQ ID NO: 1363 - DNA, 661 bp, Homo sapiens
  misc_feature [331]..[331]: Chromosome 11, SNP identification no. = rs7950144
  misc_feature [331]..[331]: allele = g, in linkage disequilibrium with rs890248, respectively
  misc_feature [331]..[331]: n is a, t, c or g
ttcctatatttgtctctgaaattttctgaactttaaatcctcttcaaaatttaaatttaaaaagtataagagttcacttgtcttacaattgctaatctaggtggagggctcaagatagtttagtttgggaattgtcaacatctatgaagggtctgagatgcttaccctacttgtaagttaaccagatagactgccacagtctcatgtatgccaacagaaggtgtgtgacttctgggtcagaaacaaaagactttattactcaatggcaacagcagtggccagggtgtcagcacttgtgtcagtttcccaacttccagggcaatacaaaganggttgtattacagaagaggaacactgggtttatggaacctaaatcttttctaatgggtggtaagactgcttggtctatgctctggacactgttttccaaagtcataagccaatctgccattgctccagagggagacaccatatctatcttccaaggctggttgtgacataagcatccttggaaatatagcctaagacaaagtgagccaattccttgctcataaagtcttcagaaattcaagggaccaatggagaattatctctgaacagaaatttttcaatatgtgaagatttaccctgctataatagcaataacataggactaattatt

SEQ ID NO: 1364 - DNA, 661 bp, Homo sapiens
  misc_feature [331]..[331]: Chromosome 11, SNP identification no. = rs1318986
  misc_feature [331]..[331]: allele = a, in linkage disequilibrium with rs890248, respectively
  misc_feature [331]..[331]: n is a, t, c or g
cgagagagaatagtcaccctcgatttgcgaatcacgtttacctgtgtttctttcctttttgtctgtgaccccggatgaactcccacctcccgctctcctcctactcctactttttgatagataaccatgatacgaataatgaacccactactttattagacatgtggtctgaggacactgtacattcaatggatatattgtttagacgtgtacatggggactttaattttattttcaattttttttggttattgttgttgtttttttggtttacttttttgttgatcccttttttacacaatgtatctgtagtaccttatgatgtgtctgnactttcttttttactttagttcaggaaacgtcgttgtacctacctcgacctccgatatgaggattcgtttaattacgtccttctctttcagtttatggtgttcaagagtgaagattcaccctcgatttgtaactcgtgtgtacctatatttgtacccttgttatcttcgacatcaaatgatctccctttcctcacccctcaccaaaccttttgatggctaacccatgatacgagtgatagaccgacgttatatgggtgcatcgtttggacgtgtacataggggacatagattttattttcatctttaactttttttattttcttcttctt

SEQ ID NO: 1365 - DNA, 661 bp, Homo sapiens
  misc_feature [331]..[331]: Chromosome 11, SNP identification no. = rs1025166
  misc_feature [331]..[331]: allele = t, in linkage disequilibrium with rs890248, respectively
  misc_feature [331]..[331]: n is a, t, c or g
ttattttaaatctataataggaaaaataaaacgtccactcctttgactcccaatatattcaacactgaacgagtcccagtatctcgatatttcatcaccccaaccctaagtttagaccttttcaacctgaagttttacacaataaaattgaattttgtcttaatgataaactaggtctttagggaaataacccatatatgagtttccttatatttaacaagatgtcatttctgtgtatgtacgtatacaagtaacttcgtgataagtgttattgtttctgtacctaagttagatttacgggtagttaccatctgatctatttcttacatgnatatgtggtgtcttgtgatgtgacggtacttttcttactctaatacaaaaaacgtcgttgtacctacgtcgacctccggtaataggattcacttgattccgtccttgtcttttgacttacggggtacgagagagaatagtcaccctcgatttgcgaatcacgtttacctgtgtttctttcctttttgtctgtgaccccggatgaactcccacctcccgctctcctcctactcctactttttgatagataaccatgatacgaataatgaacccactactttattagacatgtggtctgaggacactgtacattcaatggatatattgttta

SEQ ID NO: 1366 - DNA, 661 bp, Homo sapiens
  misc_feature [331]..[331]: Chromosome 11, SNP identification no. = rs1425857
  misc_feature [331]..[331]: allele = t, in linkage disequilibrium with rs890248, respectively
  misc_feature [331]..[331]: n is a, t, c or g
aatattatgggttgtgtagttatgggtttattgtcatcgaattgattattgctgtatgcataatacgtcattttgcaagagtccgttaaaagtcaccgagttactacgataatttctgattctgaaaaggcagtgagatccacccaactaagtggaaggaacacaaacattgaagtgccagtgttctaccgatggtctcaagatccgtgacgcagggatcgtagggttcaccattcgtcttataatacacccttttcctagaggaaaataatcacttcttttaaacaaggtcttcggatgatctacaagggaatacggaataattggtctnggttcggaacatcggtaaagatcaacgtttcccccgactttttctctgataaaccgtttcctcttacttcaacagtactaactaaatctcgttagtactgaatagaaaacctcgacccgtgtaacttcggacttgttttatgaaaaaaaaaaaaaaatttagatgcttctgaaaccccgtcttccgtgttaccgatatcctgtcctttgattatcacagtcaatgtccatccctaacacggaaagaaagttttttatagattcggactgggttgttagaggtatttataaccttatttattttggggaaatcgtctattcgactcccggt

SEQ ID NO: 1367 - DNA, 661 bp, Homo sapiens
  misc_feature [331]..[331]: Chromosome 11, SNP identification no. = rs10768938
  misc_feature [331]..[331]: allele = a, in linkage disequilibrium with rs890248, respectively
  misc_feature [331]..[331]: n is a, t, c or g
tgataatcacagcaaacttttttttttcaaggtagaattttgctctgtcgcctaggctggagtgcagtggtgccatctctgctcactgcgacctctgcccccctggttcaggagattctcctgtttcagcctcccatgtagctgggattataggcacctgccaccacacctggctaatttttgtatttttagtagagacagggtttagccatgttggtcaggctggtcacagactcctgacctcaggtgatccacctgcctcgacctcccaacgtgctaggattacaggtgtgagccactgtgccaggccacagcaaattttattgactgnttactttggcctaggcgttattctaaggtctgtgcatctatcaattcatttagacttccaaacaatctcatgtggtcagctctataattatccccattttacagtggaagaaagtgatagagaggcagcaaaagttgcagatagtaaagtagttggtatctgaatccaggcagtcttaagcaagaatctacaggctcagtcaccacactataacacattctgcaaagctgttaaaaattatttgtttcaacctgacaaaaacaagaaatgcagaaaggattccctatttaataaatggtgctgggaaaactggctagccatatgtagaaa

SEQ ID NO: 1368 - DNA, 661 bp, Homo sapiens
  misc_feature [331]..[331]: Chromosome 11, SNP identification no. = rs10899009
  misc_feature [331]..[331]: allele = t, in linkage disequilibrium with rs11236164, respectively
  misc_feature [331]..[331]: n is a, t, c or g
taaaaacacaaaagaaaacaaaacaccacaatctgccagggactgcccaggatgagcaggtgataggggctgggcccagcttttggctttctctgagcaatctcccaccaccagcactgagaccaagctgggcttgagacagagtcacgtggctaaagagcagggtttgttactcttcagccatcattctaaagcttctccgcacatatttcctccttgacagatctgggttcagattttgactctgtcccttactaagtgattcggggcatgttgcataatctctctaagcctctttttcctcatttgcaaaaggtatgacactcaaacntatgtccatgtccaggggattcccaggatgtgagactttcagtgctaaactctgggctggttaccttagggtataaggaggataatgttgagaaagcatttatcgcaacacccagcacactgcaattgctttataagtaattgttattatcctttcctcttgcctcagatatttttgtttttgtttgtttgcgttgcccaggctgaagtccagtggcaccatctcagctcactgcagccttgacctcctgggctcaagtgttcctcccacctcagcctcccgagtagcagaaactacaggtgtgcgccaccacacctagctaatttttgt

SEQ ID NO: 1369 - DNA, 661 bp, Homo sapiens
  misc_feature [331]..[331]: Chromosome 11, SNP identification no. = rs10793092
  misc_feature [331]..[331]: allele = a, in linkage disequilibrium with rs11236164, respectively
  misc_feature [331]..[331]: n is a, t, c or g
agatgaggaattcaccaaacatgaaaaagaggtctatagctcctcagcccaaaatgtcaacaacaacgtgttatctcatcttttctccactctctctgtacctccaggccatccacctctgaatttcaattttttttgttagtttgtttatttaaaaccaggacaatactgctttcatttactttgttttaaaaatctacaacctagtgactgtattggtcataagcatgattgctgttgcaatgtgctacttataatgaatgacagcaaacaagctagggattctgtctgccacttccagcctttcctctttttacttcaataggcatcnatgataaatcaatcttatgtacaatttcttataacttttgtattttttgtagaggtggggtttctccatgttgcccaggctagtctgaaactgctgagctcaaatgatccacccatcttggcctccccccatgggattacaggcatgaaccagtgctcctagcctttgcattttaactgggtaatgtatataagtatagatgccaggtttttaaattttttgtctgttgcttggttggctggttttcttgttttagttgcccaacatctgaatcctaccccttccttatattcagagaactctcgaccatctgagccttggagagaggca

SEQ ID NO: 1370 - DNA, 661 bp, Homo sapiens
  misc_feature [331]..[331]: Chromosome 11, SNP identification no. = rs10793093
  misc_feature [331]..[331]: allele = c, in linkage disequilibrium with rs11236164, respectively
  misc_feature [331]..[331]: n is a, t, c or g
tgtcaaggttgtacgtaggaacacgtgaagcctccctgtggggtctagcagcagggctctttgcagccctcaagcctgtttaggacctgggctcgttgcctctctgtcctcatttctgatcattgggtctttgaaggaagctggatttccccattagcttatctataatgctcacttgataacagacaatagtcattgcagtggtgcaaggaaaagtagacaacaccttccacaaacaatattctgtaactcaacaaaaaggactatagagcagaacaatatttaattcaatttcatccacccatccatctattcaccaggcattcagttnccagccaataaatatttgctaagggcctgtccattccagttttagccaagcagggtgctgggaaccagggatgaaaaggcctttgaagaattccatgtcccctcctgcagattccagccttcagttcctccagtcaggcctccctgactgacaacactctagacggagcagaccccacaatgcctggcatgccttttcctaacacaaacgtccaccaccacctcctagccctgtggcttagacagacatgctatgaagctcacgaccatcctcaactccttccacctctccatttccatgtatttaattggccagagttgtcctcacctt

SEQ ID NO: 1371 - DNA, 661 bp, Homo sapiens
  misc_feature [331]..[331]: Chromosome 11, SNP identification no. = rs11236164
  misc_feature [331]..[331]: allele = a, c
  misc_feature [331]..[331]: n is a, t, c or g
gatcctccctcctcagcctcccaagtagctgggattacaagagtgagccaccacacctggctaatgtttgtattttttagtagagacagggttttgccatgttgtccaggctggtcttaaactcctggcctcaagtgatcctcctgccttggcttccccaagtgctgggattataggcataaaccaccgagcctggtcttaagattactttaatcttatactccttagttgacctgttaccctgcttggaaaacgttacccccaataaacctgtagtatccctgaaggctagccaactgatagggttcctaagttgcccccaagggcttcntttcctgtccagaggcctggcctccttccctcctctgagtttggggatcctgcctgcatataggttgattgctcatcaccctgccccaatattgagccctgtctagatttcccactccatgccctgtcagaatcattagactgtctgatgcaattatttctgggatgaagcggggatgacgaagaagacagaggagggtcagccttctacttctgacacctatcttaggttcttttttgaggcatggaggctgaggtggttcggtcctatggttcccactgctggtggcacctgacaccaacatccccaacagttttgtctgacctctct

SEQ ID NO: 1372 - DNA, 661 bp, Homo sapiens
  misc_feature [331]..[331]: Chromosome 11, SNP identification no. = rs7944514
  misc_feature [331]..[331]: allele = t, in linkage disequilibrium with rs7939226, respectively
  misc_feature [331]..[331]: n is a, t, c or g
cagcctgggcaacaggagcaaaactccgtctcaaaataaataaataaataataaaataaaatatggacaatataatacatttgcagcattgctatgaggactaaatgaaatattgctcttaaagtacctggtatagtaggtctggtatataataacgtaatagtcaacgatcatagattttattgtgtgcaggtactgcatgagagttttatgtatattatctcatttgtaactggccaaatagaattatttgattttctcatctgcttccagtctttcacgtctcagtcaagggcatcaccatttacctaaagatttatgttccatatcnaggtattttccttgattcctgttttttccacactccactcgtgtaattcatcagcaggttttgccgactctaaaacaaaactcaagtcactcagttctctcaatttccactaccactactctattttaaaaaatgtattggtttggcgttgtggcttacgcctgtaatcccagcactttgggaggccaaggcaggtggatcacctgaggtcaggagttcgagaccagcctggccaacatggcgaaaccccctctctactagaactacaacaaaattagccgggtgtggtggcgcatgccagtaatcccagcaacttgggaggcagaggca

SEQ ID NO: 1373 - DNA, 661 bp, Homo sapiens
  POLD3
  misc_feature [331]..[331]: Chromosome 11, SNP identification no. = rs7939226
  misc_feature [331]..[331]: allele = c, in linkage disequilibrium with rs4944051, respectively
  misc_feature [331]..[331]: n is a, t, c or g
ttcctggaaatttaagcattgatagaggtttgatccgcttcacacgggtgaggaaaagatcgagcgaattgatggatgtgagtgcactttgcaaaccgtgatgattgagtgcctgctgtgtgccaaggcactttaatctttacagtgacctccccgcaccccatcccaggtcggtggtggtatcccgagatgaggaaattgaagctgaggggccaaataacttgtttatttgcgtttggtaagggataggcagtttttcaacctaggtctgtcctcttactaatgctttcttctacatcacactgcctttgcctaacctgtgcaagtcttntaactattggaagcttgacatttggaattggaagagactttgagagaagagagtgcaggcatcctgggtctaggagggatgaaggcttgatgctggtagttcccaatctaatctcttataaaaatatttacccacttttttcgtttcctgacccctgcaccacctgtgccctttaatgtttgcatgggtgcaactttctttagaagtttctgagacatcacacttcaaagtcatctagcttctgaatgagttttaggatggctttggctggtggcccccaaaaaaaacatcatgaggaaagggcctgagtaaaacaaggaatgtgaggaa

SEQ ID NO: 1374 - DNA, 661 bp, Homo sapiens
  POLD3
  misc_feature [331]..[331]: Chromosome 11, SNP identification no. = rs10899013
  misc_feature [331]..[331]: allele = c, in linkage disequilibrium with rs7939226, respectively
  misc_feature [331]..[331]: n is a, t, c or g
ggtgttagttcaagctaatttttaaatgaatcactgaaatgtataaatattgactatatcttctaggaatcacttggagttgattttttgtgtatggtgtaaggaaagggtccagcatcatttttttgcacatgggtatacggttatcccagcattttataattcatattattgtcttggcattttcttgctaattatatgtctttccccactagaatataaactctatgaaggcaggaaacttgtcaggttcatcactgttctgattactattgctgtgtcagaaatcaccccaaaatgtagtgcctggaaacatcattttattatgcgnatagattcttttgctttggaatttggatagggcacagtgggaatggcttatgtctgttccatgatgtctggcatccccgctggaaagtctcaataactggaacctggtcatctctaggcatctttatgcacatgtctggctgttgattctggccatctgttgggcctttagctggggcagtggactagagtgcttgcatgtggtctatctgtatggcctgggctttctcacagcctggtgtctccaggtagtcggacttcttacatagaagctcagggctccaaaagcttgtgttccagcacaatgtagagccaattgccttttctgact

SEQ ID NO: 1375 - DNA, 661 bp, Homo sapiens
  POLD3
  misc_feature [331]..[331]: Chromosome 11, SNP identification no. = rs6592573
  misc_feature [331]..[331]: allele = g, in linkage disequilibrium with rs7939226, respectively
  misc_feature [331]..[331]: n is a, t, c or g
ggtcaggctgggagatataacaaaagcctgtttctaccaggaagaaaaaataataaccaggcatggtagcatgcacctgtggtcctgtttacttaggaggctgaggaaggaggatggcttgagcccaggaattcaaggttatagagagctgcgccactgcacttcagcctgggcgacagagtgagactctatctcttaaaaaaaagatgtgccctggtgacctgatggtgttggggaagggttcatacttcatagaggaggtgacaactgagctgctgtcttgatgagaaattaggtagttgaggcctgagaagagccttctaggcagaangaagggcatatacaaaggaataaagagaattgtagaatgtttcattaaggatgaagatagtgtaggtatgatggggaatggtcagagatacagagcccagaacaagaagggtcttacctgtcattgctagagatttgaagttgatccttaggggatgagaagctactgaaagctttgttacacttttttttttctcctccctttttgtggaacatggggtctcgctatattgcccagtcaggtcttgaactcctgtgctcaagctatcctcctgcttctgcctccctgagagctgggattacaggcgtgagccaccacacctggcgctac

SEQ ID NO: 1376 - DNA, 661 bp, Homo sapiens
  POLD3
  misc_feature [331]..[331]: Chromosome 11, SNP identification no. = rs7940880
  misc_feature [331]..[331]: allele = a, in linkage disequilibrium with rs11236164, respectively
  misc_feature [331]..[331]: n is a, t, c or g
tgcgccactgcactccagcttgggtgatataaaataaaactggaacgtcaatttagtaatttacaaggagcaacaaaactgctagagggatcctatccttatactctctagccaacatattcttttcttgtttccaagctatttggcaagccaaatgataaccaagatatttgcaagtgtaaaataagatgtcatttatatctctgaagcaaagttaaacagacgtaactcatttacttgcagagataaacctgcctccagagttctgccactgtagagctcttgaatggatactgtcaaagtttatggctgattgtcatattttcttctntttccagggtcaactgaccttctgtctctttctctaattagtcagtaccctcaatctagtcatattcaagcctttacttggaaatcattatgtttctttaaagcagtgctttttattctttttttggtcattgatccccttgagaatctgaaagaaaaatgcatatgttgacattcataaaattttgagttcatggatcttctggaataggatccaaagttaagaatttacgttttgagataatgtagatttttactcaaactgacccattataacaggggctcttaatttaggattcttagatggtcttcatggttggtcttcaaagtc

SEQ ID NO: 1377 - DNA, 661 bp, Homo sapiens
  POLD3
  misc_feature [331]..[331]: Chromosome 11, SNP identification no. = rs10219203
  misc_feature [331]..[331]: allele = t, in linkage disequilibrium with rs11236164, respectively
  misc_feature [331]..[331]: n is a, t, c or g
cagtggcattggacaaattacttaaactctttgagctttggtttctttgcctttaaattcaatgtaataatgtctcctttgtggggttgtattgataattcagatcagttccccagacatacattgagcacctactactttgacaggtactgagcaaaatcatttgaattcattcagcaaataactcatgagtacctatgacataccatacagtatagagtgaatgtgcccgcgtaccttttcatgtaactgatgggagacaggcagttatggtacagtgtaagagtactgtaataggaggaatattgggggaagatgttggcaggggcanttatctcccacttttggatggatagagtgaggggacaagactgttatgacttatgacacagaaggttatgatatctcagttgaggcctgaaggcccagtagaaatagccaggcaaaggaaaaatgagagactaaggacagagctaagagagaaaacatgcttgtgcagaaccatgatcgttttctatgggtgcaacttagagtgaaaggtaggaaataattagatagaagactaaagaggccaagcaggaattacattatgctttgactactaggataaaaatttagactctattctgagagcgctggggagccactgaaaatatttaag

SEQ ID NO: 1378 - DNA, 661 bp, Homo sapiens
  POLD3
  misc_feature [331]..[331]: Chromosome 11, SNP identification no. = rs4944051
  misc_feature [331]..[331]: allele = t, in linkage disequilibrium with rs7939226, respectively
  misc_feature [331]..[331]: n is a, t, c or g
gaggcctgaaggcccagtagaaatagccaggcaaaggaaaaatgagagactaaggacagagctaagagagaaaacatgcttgtgcagaaccatgatcgttttctatgggtgcaacttagagtgaaaggtaggaaataattagatagaagactaaagaggccaagcaggaattacattatgctttgactactaggataaaaatttagactctattctgagagcgctggggagccactgaaaatatttaagcagatggagtgaaattatcaaaattgcattttagaaagattgctctggttgcagtattgaagataaatcagaagagaataanctggaggcaaggccatcagggaggagaaatgtggcagtaatccaggtggatatgacagttttctaatgtgaagttgtgctgttggggatggagaagtatgaaggttaatgagtcatgaccatcaaaaaacctcagtttggccgggcacagtggctcacgcctgtaatcccagcactttgggaggccgaggcaggtggatcacgaggtcaggagattgagaccatcctggctaacacggtgaaaccccgtctctactaaaaatacaaaaaattagctgggcacggtggcaggcacctatagtcccagctgctcaggaggctgaagcaggag

SEQ ID NO: 1379 - DNA, 661 bp, Homo sapiens
  POLD3
  misc_feature [331]..[331]: Chromosome 11, SNP identification no. = rs7943085
  misc_feature [331]..[331]: allele = g, in linkage disequilibrium with rs4944051, respectively
  misc_feature [331]..[331]: n is a, t, c or g
ttgcagctcagagtgggtaactagaaaagcattaatggttgcagtggtagtagtttatttatataagattctgatattcagttctgatttttctactttagtttgaaccctttaatacttgatattgttatctgaaagagttcttttgcttttgataatgattctcaccaaaccttggatttcctttgcaaaatggtaatgcctaccttgtgcacattacaagattgttgtgaaacccagatgaaaacatgtgaaaacacctcgagaattgttgacattcaaaaaaatgtttatttgcaatatgtctttctgaggaacatcttatattctnggctttgcaacatataccttccttcctagtgtatttcccattcttatactttatgcaggtttttttgttttgtttttgccttatttgcttctcttagatttttattgttcagtcatctgaactaactcaagggcattgacttaagaaaagtatcattaagatactattttaaaaatccagaaaagcataattattgttgttactattattattatcactgtcattttccagtgtcaagtgtatttaattcagatcactgtcattttcaagcgtctgtcttgggaaagaagaaggatggaggaaaacactaacgtttattgaatttcaact

SEQ ID NO: 1380 - DNA, 661 bp, Homo sapiens
  POLD3
  misc_feature [331]..[331]: Chromosome 11, SNP identification no. = rs10501417
  misc_feature [331]..[331]: allele = a, in linkage disequilibrium with rs4944051, respectively
  misc_feature [331]..[331]: n is a, t, c or g
agcccatattgctactaaatggtgggaaccaggaattcagatctacttctgatgattaaaaatgtaatgttttaggttttcccgctttgtgtacatactgcctctgatcttttttaattctgtcaaattaaatagtttttaaatgtgctcaagaaaagtttagctatatccatggataattaattttataagatatataagaaactaagctttagagattaacaccagttactgtctggtgtggattattgttctagatttgttcttatatctaacacctacgcgttttggcatgattatatagagactataccatcgcaacagtttgctntagaagagtttgtttgagactgctacttcatgaacagcctaaatgccagcaaaaaatcatatgtgttttctgtgcttgtaggcatctgcagcaggcaacaaggcaccagggaaagggaatatgatgagcaacttttttggaaaagctgctatgagtaagcatgttcttacctcactttgactaacgaatgaatgttaatgtaatgacatattatacctgaagtgaaagccactttgtctagtttttgccaatccaagagactacctgcattctaacaaatttccagtgtactgcccaatatattgatgaaagtaactcagctagaacttt

SEQ ID NO: 1381 - DNA, 661 bp, Homo sapiens
  POLD3
  misc_feature [331]..[331]: Chromosome 11, SNP identification no. = rs4145953
  misc_feature [331]..[331]: allele = a, a, in linkage disequilibrium with rs7939226, rs4944051, respectively
  misc_feature [331]..[331]: n is a, t, c or g
gcaaatattttgcctttcttcagttattttttgcagattactcacagtaatgaattagacttccagtgtgaattagaagggcccaagtagtaatggacatttaaaaatcttttttgagaaagcaaaaatcttctttatttttaaaaagatacttaagtaagaattctttcgtatggaaagaaccagtagtcacatattttcatacttctcatatcaagtgtacatcccctgagagtatgtggtagaataccaggaagaatgcaggagccacaggataattatggcacactttcttggagcatcagttttacaaagatttttcaaggaggcnttttgttacatgcctatgcaagcaaaattagttagaattctgcctttccatgatggctaaattggtggtcacgggagggattgaagtgacttttttttttttttcatattctgcttatgtaagggtgacagtttttgtgtttgctgtaaaagctatcagagaacgtttttgtgttcttgcagctcagaatgggtaactagaaaagtgaatggaaaatgtgatacttaaaggttactcggaagcattattgtattactgcaggcacagttggtgcacagggaatgcttcctacttctgttaaaacaggtctccaacccacagtccactgat

SEQ ID NO: 1382 - DNA, 661 bp, Homo sapiens
  POLD3
  misc_feature [331]..[331]: Chromosome 11, SNP identification no. = rs11236173
  misc_feature [331]..[331]: allele = a, in linkage disequilibrium with rs4944051, respectively
  misc_feature [331]..[331]: n is a, t, c or g
atggctaaattggtggtcacgggagggattgaagtgacttttttttttttttcatattctgcttatgtaagggtgacagtttttgtgtttgctgtaaaagctatcagagaacgtttttgtgttcttgcagctcagaatgggtaactagaaaagtgaatggaaaatgtgatacttaaaggttactcggaagcattattgtattactgcaggcacagttggtgcacagggaatgcttcctacttctgttaaaacaggtctccaacccacagtccactgatgggtagcagtccgtggcctcttgggaaccgggtggcacaggaggtgagcagcnaatgagcaagcgttattatgcctgaactccacctcctgtcagatcagtggtggcattagattcttataggattgtgaaccctattgtgaacagcacatgtgagggatctagattgcgggctccttatgagaatctaatgcctgatctgaggtggaacggtttcatcctgaaaccaccgcccccgaccccccaccgccgcccaccaccacccctgtctatggaaaaattgtcttccatgaaactggtccctggtgccaaaaaggttggggactgctgtgttaaagcatcatgctgtcactgacctgcctggctgttatggttttttttaaa

SEQ ID NO: 1383 - DNA, 661 bp, Homo sapiens
  POLD3
  misc_feature [331]..[331]: Chromosome 11, SNP identification no. = rs10793094
  misc_feature [331]..[331]: allele = g, in linkage disequilibrium with rs11236164, respectively
  misc_feature [331]..[331]: n is a, t, c or g
aagctatgcataatagcccagactatgataccaatttttttctacactgtagatggtttaagctattatacaacatataaccaaaactacttattgaagcacctccagctaatgacagctttctaatagtattttgtgcctttacttgtgaaaagctatcactaagtacagcgtgaaggctagatgacatgcttctatagttcctcagatggctaggcctgtttgcatttcttagttctccctgctgcactgtagtcattcttcagcttggtgtagggaaagggttaaggactttgaggagttaaactgactttggttcaaatccctactnttttctgtcagtgttacctggataaatcatttaaccaatactgatctcttttaatccttatgataatcttgtaaatattatctcaggtttagaaaagactgacttagataaaataacttgcccagagtgaagcggggtttgaaccaaacttctttgactccaaaatagtctttaaattttatcattaaggtagtagtgagatattaagggtatccaggcattaaaagatagaatatatagaaagcaaaggtcttgctgcaaatcgttgtcaccatttgtaaactgtgtattgttgggaaacatcttgtaatccttctgattcttgatttt

SEQ ID NO: 1384 - DNA, 661 bp, Homo sapiens
  POLD3
  misc_feature [331]..[331]: Chromosome 11, SNP identification no. = rs1433970
  misc_feature [331]..[331]: allele = g, g, in linkage disequilibrium with rs7939226, rs4944051, respectively
  misc_feature [331]..[331]: n is a, t, c or g
actctgtgatgttcacacagtgaagtcacctaacaatgcatttctcaaaatatgtccctgtcattaagtgatccatgaccgcagttgggagaagtttcctctgttttctgaaggagtttatatatacgtgtatatttttcaaatgtttaataaaatttaccagtgaatccagggctggattttatttgtgggaaaggtttttattgtgaatttgatttaactagagctgttcaaattctctagttcttcttggatcagttttgactgagttgtgtttttaaaactcagtcaaaatttgatctaaattgttgagtttattggcataaacccnttcattatataactttattcttcgagtttgtagaacctgtactcgatacagatttctttactgtttcattcctgattgataatttatatttttctgttttcaaaatgggttttataaaaggcttattaataaaattaatctcccaaaaataacaactttggctttgttaattttctcttattttttatctcactgatttctgctcttatctttattgtttccttttactttgggtttaattgttctttttctagttcaaggtagaaaggaaagttggtatttaaagttatataggacataaggtacttgatggcaaagattatgtcttgt

SEQ ID NO: 1385 - DNA, 661 bp, Homo sapiens
  POLD3
  misc_feature [331]..[331]: Chromosome 11, SNP identification no. = rs2155935
  misc_feature [331]..[331]: allele = t, in linkage disequilibrium with rs11236164, respectively
  misc_feature [331]..[331]: n is a, t, c or g
ttctttactgtttcattcctgattgataatttatatttttctgttttcaaaatgggttttataaaaggcttattaataaaattaatctcccaaaaataacaactttggctttgttaattttctcttattttttatctcactgatttctgctcttatctttattgtttccttttactttgggtttaattgttctttttctagttcaaggtagaaaggaaagttggtatttaaagttatataggacataaggtacttgatggcaaagattatgtcttgtatatatttgtttctctaacattcagtaggcctttgataaattacttgttggttncatgaggagtgtgatggagtatccattcatccagaggagctaaataatgtcatgatggagtctaggattttttttattattattatgtcattagaatcaccttaaaaggatatctctgcctttgctcatattgttctttctctttaaaatatgtttcccctttctacatgatgaacttctacttagcttttaagttttccaaatatgaattatattccataacattttatttgtccagttaaatctaccacattgccttatagccagtggtgtttgccagagcttcttgaaaacagtattttcttctgtattgttgcattctcaatggct

SEQ ID NO: 1386 - DNA, 661 bp, Homo sapiens
  POLD3
  misc_feature [331]..[331]: Chromosome 11, SNP identification no. = rs2298792
  misc_feature [331]..[331]: allele = g, in linkage disequilibrium with rs11236164, respectively
  misc_feature [331]..[331]: n is a, t, c or g
ttccgattacgtctaaagtttgtctttctccacgataccacagagaattacgatcttaatgatgagagtaacactaggaattaggtaatgaaaaaatcgaggaacttgtaactttcattttaactagggggattgggttttacttaccattacgggtggaagtagaagtgacgatagtctaagtccttcaaactaagaagaggagaaaaaggagtacaaaagtcaaaggaaacagagtagtagtctattacgatgagcgaagggggacaacggtaggtctttatttaattcgcacaatgtgtcttgtttttacattcataagtgtacgagnatacccaaaacgaaatattgagcaccagaattaaggtctcccatcttttcctgccggtttatcaggttcttcctgagaacaattcctatgagacgattgactggtgttgattcagtgaagtactccactgaacttattttttcaagatctcaagagatctctgacgaccttcgatgttggtccaatagttcttagaaaggtttaaggaagaatgaagggactaaccggaaagttaataggttgttcgtaatttattcgtcgatgatgtatgtatgttccgagaaacgatcggtaactcttacgttgttatgtcttcttttatgacaaaag

SEQ ID NO: 1387 - DNA, 661 bp, Homo sapiens
  POLD3
  misc_feature [331]..[331]: Chromosome 11, SNP identification no. = rs11236178
  misc_feature [331]..[331]: allele = a, in linkage disequilibrium with rs11236164, respectively
  misc_feature [331]..[331]: n is a, t, c or g
ggacgactctaccttgaaaagcccactttgagacacagtggtgaaaagtttgaactgctctaatcaattgtccatgaattcatggcataatgggtataaaacattttaagtaatgaggggaaatctagtccaaaggatttcagcatcacataaagatacagagacaaacacgaacagatactaaaagggagagtaaagaagaataatgaatgcaaaaaaggaacctactgagctatcaaaggacaaacttgtaagattctgaaacttgtaagattctgctttttccagaaactactctaagaggaattgaaaatggtaagagaggcttccnaaaaaaggatattagctcaactatacaagtgagtgaaaaaaaaacaaattatatatacagttgacagtaatgcaaaagaaatgaacagacccaagaaatagtagcaggaagctgaatctgtgataaaggtgtagcatctttgacacttctgtggatttagattctaccattcatgctatgtgtttagaattacagcctgtgatatcctgtgagaggtacaatgtccttccgtgggttttagtggctctttagaatgggtaggagtaagacacgtgagcatcccagagaggcaaatgctgtattttcattccattgtcatttatcaaaatg

SEQ ID NO: 1388 - DNA, 661 bp, Homo sapiens
  POLD3
  misc_feature [331]..[331]: Chromosome 11, SNP identification no. = rs3824999
  misc_feature [331]..[331]: allele = g, in linkage disequilibrium with rs11236164, respectively
  misc_feature [331]..[331]: n is a, t, c or g
acatcctgtcgtcttactctgttctcggtagatgaccgtaaacacttcatatgtcgttcccttgattaaatcgtatcaccaacatccaggaattctgtgtttcctacgtacctgtacgttcttagggtcatattaaaatggaactgtcttcctccaagtccgagtcagaaaccgtgaccaagttctccacctctgcctcctcctccacccctaccactgagtcgaagtattcggggtcctctcagacctttctgactttattactttgcctgaatctagtctcttgatgttcgtgatagaccatatttcggaagaggtaaccaagagattnaactgtacaggtcgtttcccctaaatcgttcgtcattaagtactgttggttcttgagacatcaatatatcaatagaaattttatgtataaaataattaaaatatgtttattttagtctcttagttcttaataatgtcggccttcatagaatcgatttataaaagaaaatatcgatcagtccaatacttcaaccaaatgtttataggtgaatagcggaaagtatacggtacataaagtgaaataagaatgttgttgagattctctgtctaaaagaataaacgtgtaatgtcatttatctccaagtctccccaaggatttgaacggttccag

SEQ ID NO: 1389 - DNA, 661 bp, Homo sapiens
  POLD3
  misc_feature [331]..[331]: Chromosome 11, SNP identification no. = rs3741127
  misc_feature [331]..[331]: allele = a, a, in linkage disequilibrium with rs7939226, rs4944051, respectively
  misc_feature [331]..[331]: n is a, t, c or g
aaaacaaaagaggtgaactcgagattttccagtctcctatgttacaattcgacctagttaatacaatatgtctttttattgttttcgaaaatttagatatgattagtgagaggttatgaggtaatactatttttcaactttctctttgagatgtaatcaaaatctcttggttggggtagtgtgtctgttcaatgcgggtgatatatgtgtccgaactatgaagtaacaagtattcttcctttcatcgtacgacttctttcttgacacaagacaagtaagtcagttatttgataacaacccatcacgtccgtcgtaccaatttttctgtatntcctattcctggaatcacctcctctctctcttcctttcgtctggtgacgttatgtcacatcactcccgactctgtctataataccctcatgtgtccctaccggggatttggtgtggtccctaaagacaccgtatacgggaacgacatctatgaacgatacagtcggaagtgtaaagaacagaagaaaaaaacaaacaaacaaaaaatctctgttcaagaccgagacaacgggtccgaccttacgtcttcacgttagtattgagtgacgttgtcaggttgaggacccgagtttactagtaggatggagtcggagggttcatcgactttgat

SEQ ID NO: 1390 - DNA, 661 bp, Homo sapiens
  POLD3
  misc_feature [331]..[331]: Chromosome 11, SNP identification no. = rs1051058
  misc_feature [331]..[331]: allele = c, c, in linkage disequilibrium with rs7939226, rs4944051, respectively
  misc_feature [331]..[331]: n is a, t, c or g
actcctcacttactatgtaagttcatctagatctccacctcacctgtatcaaaagactgttctttcatcctgtgaggtttatactatttctggtttttaaccaaaaggaaatcatctggaagcaggaggcaaaaagctgttaccttctaatgacatttaaaaagcacagtctttgacctgtccaggagaaggatttactccaaaattatactggaacagttttcagaattctcactgaagccatttagtggctaacccactgtgctccactcaccctatgccctggtccgcatatggcacaggaattattccttcttgttcctctgtattntaagaattcatgtgggtgtttcttatccttacattctgctggatacgtttacccctcttgtcttcctgcagtaccacacttctgtcccctaacctcctgaggctgttctctgtaagtcttttaagttttggttggactaaaggctgaagtgaaaatctccctgtaatcctcttcctccattatgcagtacacggacacctggctacagaccaggacgtggcttgtgttctgttcctttcacaaaagctctctgggaccttcacttgcaattagtggttagggaaaagcctcaggcagaacacaaatagaaatttaatgatgtgttcaact

SEQ ID NO: 1391 - DNA, 661 bp, Homo sapiens
  misc_feature [331]..[331]: Chromosome 11, SNP identification no. = rs7123887
  misc_feature [331]..[331]: allele = t, t, in linkage disequilibrium with rs7939226, rs4944051, respectively
  misc_feature [331]..[331]: n is a, t, c or g
gaacacccattccccttaactgttctcattttctctttccagactccatgtttcttgaggtttcaccttggctccctgtacctactttcttaatattcagagttcttcatggctggttcttcagcttcattcttttggtgttttaggctttctcaaggctcttcatggcatgtcttttaccggactgctcttgaagaatggaaaaactactttgtttagtgtctgtttgggatcagtcagatccaaagcataaagcagttattggaagctagttatgtttagtcctggataaaatactttggggattgtaagagcccgtaagttaccattntggagtgacaagacaaacatactaaatagcatttagcatttgacacaatgcttagatgagtgatagacatgggacttaataatttaggaatgaattaggataatcattatgggcaaaatattatattcctatgcaaagaacaataaaagatttaaagaaagaaacaggctgaggtaggctaaccattttattgggtgttattcagctatttgaacttcacttgccacttgtacattcacggtgtaagtaaaccatgatttagtgaatctttaattaatggagttatttctgttgtgctttaagcatgagagtattgacgagaaagcaagc

SEQ ID NO: 1392 - DNA, 661 bp, Homo sapiens
  misc_feature [331]..[331]: Chromosome 11, SNP identification no. = rs4944922
  misc_feature [331]..[331]: allele = g, g, in linkage disequilibrium with rs7939226, rs4944051, respectively
  misc_feature [331]..[331]: n is a, t, c or g
tttctgttgtgctttaagcatgagagtattgacgagaaagcaagcagttatcaggaattacttcaaaaggcagtttatacaatataaagtctgtataggctccactcagttttgtacacactcaacaattttgacctactagggaggcaggatgccgggatggaaacaacacaggctttagagacagagggcactggatgcaaaccctgtctgaggcactgaccttaagcaagatatgcatcctctctgaacttgtttcctcatctttaaaaatgagctacccacctaccttaaagcgttgctttagggcgttaatgaaataatgcatggncagtccccagtattttgacacctattaaactaatacaaagcagagtaactcacatttacctcttttaatcctcatagcagccctgtgagataggtacttttattcccattttgcacatgagaaaactgcggcaaaggggttaagtaacctgcccaaggtcagagccacgatataaatcatgacaatttggcttcattgccctcagtcttaaccactgtgctatattgcctcttggctatgtattagttcatacttccataccgcccagtgatgattgatgttttttttttttttttaagacagagtctcgctctgtcacccaggctggag

SEQ ID NO: 1393 - DNA, 661 bp, Homo sapiens
  misc_feature [331]..[331]: Chromosome 11, SNP identification no. = rs10899024
  misc_feature [331]..[331]: allele = g, in linkage disequilibrium with rs11236164, respectively
  misc_feature [331]..[331]: n is a, t, c or g
accataaaacctgataggagtgttttcccttgtccctcttagttgtgttctatatgtatttatatgctttactttatcttacttcatcctcatgataacctgcaaggtctctcccacattttgcagaaaagaagcccagggagttgagctagtatggccagcatctcacagtgagaaagtgtaccagggctagaacctaggtcttgagactttgtgtcttcagatgctgcatcatgtgactttcccacagtatagcaacccctaagaagaatatattggtgcacttacaaatgtggcttgagtcattaaatgcttgcttatttgcccaacnactatggtggctactgtggattccagaaaagtacatgacaagttctctgccttcctggaactgaccatctgttgggaaggcaaaaaaacatgtacatatttgtacatttcacagatttttgactaaaagtttactgtgtacccagcactggtgcattaaatactggggatacaaagatgaatttcttgcccttgatacatttactatctagtgaggagagagacagacaaatatgctataattatattataataatatttataagagtgcttaccacgggctcaaatttttgctagatatttaatacactttctctaatcctcacaacac

SEQ ID NO: 1394 - DNA, 661 bp, Homo sapiens
  misc_feature [331]..[331]: Chromosome 11, SNP identification no. = rs7106219
  misc_feature [331]..[331]: allele = t, t, in linkage disequilibrium with rs7939226, rs4944051, respectively
  misc_feature [331]..[331]: n is a, t, c or g
cctggaactgaccatctgttgggaaggcaaaaaaacatgtacatatttgtacatttcacagatttttgactaaaagtttactgtgtacccagcactggtgcattaaatactggggatacaaagatgaatttcttgcccttgatacatttactatctagtgaggagagagacagacaaatatgctataattatattataataatatttataagagtgcttaccacgggctcaaatttttgctagatatttaatacactttctctaatcctcacaacactttatttacacatgaagacaggaaggctcggagagtttaaatgatttgcccaanaagtggcaaaggtgagacatgtctctgtttaataatttataatgaaaagttagagaaactagtatatttgaacgcttgtgattagcaaacctgcatggaagtcaacttccctttgggtggatcaaaaggagcaaaatgaattatacctttacaattgtcattctcaggtaggtgtgatcttgccagtaagtctgagtctttttggctacgatctgcagcttgtatctccacttaaggaaaccacaccagtggactatatgttaggctagagatgaaggctttctcccctctggttggtgttctagctggcctggggagagggccacattt

SEQ ID NO: 1395 - DNA, 661 bp, Homo sapiens
  misc_feature [331]..[331]: Chromosome 11, SNP identification no. = rs4944925
  misc_feature [331]..[331]: allele = g, g, in linkage disequilibrium with rs7939226, rs4944051, respectively
  misc_feature [331]..[331]: n is a, t, c or g
aaaatgaattatacctttacaattgtcattctcaggtaggtgtgatcttgccagtaagtctgagtctttttggctacgatctgcagcttgtatctccacttaaggaaaccacaccagtggactatatgttaggctagagatgaaggctttctcccctctggttggtgttctagctggcctggggagagggccacatttgaactctagtctttctgacttgaagtctatattctgactactgtaccatgtccttcctcctcctgtgtaaaggaggtgtgtgtccataggtcagtgtggtcccaagaaagggttgcctgtgactgcctgaggnattaagggaagattcacagaggaggaagtgcttaaacaggtcttgagaaaaataggagtttgccagatggaaagcgagaagggcataccaggcagaaggaacaggacatacaaaggcatggacacacaagaaagcacagactgtttagagagttgtaagtggtttagtgagaggcagaatggttggctatgaggccatataagtaggcagaggccagctcacagaggtctttgctaagtagtttagaccttgcactataggcaataggaagccactgaattttaacatgtcagattcgtacattagaaagatcagctttagtagcctaaa

SEQ ID NO: 1396 - DNA, 661 bp, Homo sapiens
  misc_feature [331]..[331]: Chromosome 11, SNP identification no. = rs7932922
  misc_feature [331]..[331]: allele = c, in linkage disequilibrium with rs11236164, respectively
  misc_feature [331]..[331]: n is a, t, c or g
gaggcagaatggttggctatgaggccatataagtaggcagaggccagctcacagaggtctttgctaagtagtttagaccttgcactataggcaataggaagccactgaattttaacatgtcagattcgtacattagaaagatcagctttagtagcctaaaggtataaagtagatcataagtaacagccaaattgaacctgtatcttgagttagaacaagcagaggaaaataatttgaagttagatctagttttgttttaggcagatgactcctttgatccccttggaaactcaggagaggagagtattaggagtgacttcaaatgtggaangattagccttttgctaggtcgtctcatgcttggaaattctctggctcttgcctgagccatggtcctagttaaaccatggagatgggattggttccacggtttcaccaaggattcatgtaggccattctctgacgcacatacacacactgattcagacctggaactgactgcatctccctggaattctttgggtcaaaaatgacccatagtcctagactgatcaactaaattcatcccaaatcttactaacacctattctatgccagatgctttcatatactttatatcatttgatccgtaacaactttgtgaggtgtaggtatcagccca

SEQ ID NO: 1397 - DNA, 661 bp, Homo sapiens
  misc_feature [331]..[331]: Chromosome 11, SNP identification no. = rs1944933
  misc_feature [331]..[331]: allele = c, in linkage disequilibrium with rs11236164, respectively
  misc_feature [331]..[331]: n is a, t, c or g
ccaccccactttgggagtacgacaggtacttcttctcggttgtagtagtcttcgccgtcgactgaccgaacggatgatttcgtccacagtaccgtgatcggtcgggtcggagacgacggaactttgaagtgtagaccgtgggtttctctctctcacacacacaaatttattctgtcgataacttactcacctgactcctcccaacctcaaccgaccagaattccttactacgtttggtgttcccctgtcacgagtcctccacttgtctcttttgtctacccgagtttgacgtccgcactgatatcgggttcgtggggtatgtagtaacccnctccgaagaaacgacggtttctagacaaataaaaaagtaattatttgtcgtaagagactacagacatgaactcctttatcttacgtatgagtctggaaaccgaaaggagatttgctgaagttcatctttataccaactttgttcccacacaacacatcgtgtgtcttactgtgcgtcgggtggactttccatccccacgaccaccctgtttcccctcagtccttaaactgtccactcgtcttgacgttcctttgtgacccaggtaatcgggagggaggagtgaaacaatcttggagtcaaaactgtcagactacacgacagatgtcgtgt

SEQ ID NO: 1398 - DNA, 661 bp, Homo sapiens
  misc_feature [331]..[331]: Chromosome 11, SNP identification no. = rs11236185
  misc_feature [331]..[331]: allele = a, in linkage disequilibrium with rs11236164, respectively
  misc_feature [331]..[331]: n is a, t, c or g
gactgtctatcattctatctccagtacctaggacagtgcctagaacatagtaggctcttagaaaatatttattgaatgaattaatgaattataaaactgcctcttctactcactggccatgtgatcctgggaaagtcattctcttctctgggcttcagttttatcaacttggttgaaagcattagttctctatccctgatgctgtaagagtttaagaattcattcatttaacaaattaccttgtgtctccatagagggtactgccaagccctaaaactacacagtcatgaacaaggcagaaacagaacgtgctctcaaggagttttgaaanagagagacaaccaaataaataattgcatgaacaattatgtaatgaccattgtgataagccttataaaaggatctgtacagggcactaggagaaaaaccacacaggagggccatgttgggggttgtcagagatttcttggtgaaagtgacatttaagtcagactttacagataagtagttgaccaggcaaagatggtacagtatttcagggagagggaagagcatttgtgaaagtccagggtgggcatgtggctgtagcctggtgaccaacagggaggtcatgccaagatcaggctagagagggaggctgggccagatggttcagaacctt

SEQ ID NO: 1399 - DNA, 661 bp, Homo sapiens
  misc_feature [331]..[331]: Chromosome 11, SNP identification no. = rs4145954
  misc_feature [331]..[331]: allele = t, in linkage disequilibrium with rs11236164, respectively
  misc_feature [331]..[331]: n is a, t, c or g
ggctgggccagatggttcagaaccttgtcggctatggtaaggattctgtcatatctaaagacaaagggaagtcattgaaaacaattcctgtcattacaaaggctttactagtacatacagaggggaaagctggactcagccttacatggctgtcagaggtagatagagcagatagtacctccattttgtagctgaggaaataggccccagggatgataggtaacttaccaagaccactaggcaagtcagtggtagaacttgatctctaaaattttagtctacttttctcaatactatatcacattacaaagttgagagggttttctttccnttcacatactctagatggccaaattttagacctaaatgccttgtaataacagctctcatctgcaaattgaatgtctcgaaagcaacttttaagcaagtctgttagcaacaaatccctccagagcattatgcttgcattttgggtaactacaaccatatctttgatgcccattttagattattgttaggatagattgttaggaatagaattactgtgtcaaaggatatacattttaagaaacttttcatacatattgccaacttgtcttcccaaaggttgcgtatcatcatcagtatatgacagtgactttctcagtgcttcaagtaatag

SEQ ID NO: 1400 - DNA, 661 bp, Homo sapiens
  misc_feature [331]..[331]: Chromosome 11, SNP identification no. = rs11236187
  misc_feature [331]..[331]: allele = c, in linkage disequilibrium with rs11236164, respectively
  misc_feature [331]..[331]: n is a, t, c or g
cacagtaacttttgcaccaacctaatacttaacatcataatattcagtggtgaggatcttattttactgccattcccattccttttcatttagaaacagaataaagttgtatttcaaatacctaagagagatacacacacacatagtgtggtccataacataagtagaaataaaatacttgacaaaactagcacaaaggatgaggagggagtatggaagtatagtatactcttcttcttatgttatacttgaggtggtatattatttttaaattaataactttttaaacaacttaactgttttaagttaaatatgcgtattgtaaacctgngagcaaccactgaaaaccacaatgtataactccaaagtatagttaataagccaataatgcagatgaaatggaatactaaaattaccaatgaatgttagaaaagaaggaaaaaaaggacaaagaatagatgggacaaatagaaagcaataaaaagacattagacttaaccatatcaacattaaatgtaaatggaatgaacacttcaattaaaaggcagaaattaccaggctagattttttttttacaaatggatacaaatatgctgtgtgctagtctgttcttgcgttgctgtaaagaaatacctaagactgggtaatttacaaggaaaga

SEQ ID NO: 1401 - DNA, 661 bp, Homo sapiens
  misc_feature [331]..[331]: Chromosome 11, SNP identification no. = rs11236188
  misc_feature [331]..[331]: allele = g, in linkage disequilibrium with rs11236164, respectively
  misc_feature [331]..[331]: n is a, t, c or g
tagaaataaaatacttgacaaaactagcacaaaggatgaggagggagtatggaagtatagtatactcttcttcttatgttatacttgaggtggtatattatttttaaattaataactttttaaacaacttaactgttttaagttaaatatgcgtattgtaaacctgagagcaaccactgaaaaccacaatgtataactccaaagtatagttaataagccaataatgcagatgaaatggaatactaaaattaccaatgaatgttagaaaagaaggaaaaaaaggacaaagaatagatgggacaaatagaaagcaataaaaagacattagacntaaccatatcaacattaaatgtaaatggaatgaacacttcaattaaaaggcagaaattaccaggctagattttttttttacaaatggatacaaatatgctgtgtgctagtctgttcttgcgttgctgtaaagaaatacctaagactgggtaatttacaaggaaagaggtttaattgtctcatggttctgcaggctgtacaagcatggtgccagcatcagcttagcttctggggaggcctcagggagcttttactcatggcagaaggtaaagcaggaacaggcatgtcacatggccagagcaggagcaagagaaagaaggggaggggagat

SEQ ID NO: 1402 - DNA, 661 bp, Homo sapiens
  misc_feature [331]..[331]: Chromosome 11, SNP identification no. = rs6421715
  misc_feature [331]..[331]: allele = a, in linkage disequilibrium with rs11236164, respectively
  misc_feature [331]..[331]: n is a, t, c or g
atccaaggaggaaaagcaattcaatgtggaaagaaaagtctgttcaacaaacgatgctggaacaactggctattaaaatgtttttagaagaaaatatatagaagaacattttcatcatctttggatagtcaaacttttttaggacccagaaagcaataaccataaaagaaacatcaataaaatggaattcatcaaaatttaaaccttctgctaagcaaaagacaccattaagaaataagtaggaaaaccatagaatgtgagttagttatcaccatgcatatatctctatctctctatgtctatatatttgacaaaagacttttatccagtntatataaaaaacttatacagctcaatattaagaagacccaattaaaatctaatttttaaaaaatgggcaaaaaataagaaccggcactgaataaaggaagatataccaatggccaataagcacatgaaaatgtgttttaatattattattcagcaaaatgtaaatgaaaatgacattgagatatcactacatgcccattagaatggctaaaatcaaacggtggcaacagcttaagtggtaagattgtagaatgtaagcaaaagtctcatacgttgctggtaggagtgacacaaccactttgaaaattggtctggaactttctcataaagt

SEQ ID NO: 1403 - DNA, 661 bp, Homo sapiens
  misc_feature [331]..[331]: Chromosome 11, SNP identification no. = rs11236203
  misc_feature [331]..[331]: allele = g, in linkage disequilibrium with rs11236164, respectively
  misc_feature [331]..[331]: n is a, t, c or g
ttagtagtattcttaagatggcaatactccctaaattgatctacagatttagtgcaatctcttatcaaaatcccagctggatttttttttccccagaaattgacaagctgaccctaaaactcatatgcaaatgcaagggaccaagaacagtcaagacaatcttgaaaaagaagaacaaaagtggagaaatccttcttgatttcaaaacttactacaaaaccacagtaatcaagacaggctggttatagcataacaataggtatctagatcagtgaaacaattgatagtccagaattaaaacttacatgtatgagcaattgatgtttaaagntgctaaaaaaaaaaaaaaaaaaatcaatgggacacctggagcatcaatgggggaaagaatagtctttccaacaaatgatactgggacaactggatatccacatgcacaggaataaagttaggcccctttcttataccatgcatagaaattaatgggctaggtgagggaggaatggagagttgtccagttgtccagtaggcatagagtttcagttttgcaagattaaaagttctagagattggttacacaacaatgcaaatgttcttaacactactgaactgtatacttaacaattaagggcccggcgtggtggctcacgcctgtaatccc

SEQ ID NO: 1404 - DNA, 661 bp, Homo sapiens
  misc_feature [331]..[331]: Chromosome 11, SNP identification no. = rs11825804
  misc_feature [331]..[331]: allele = a, in linkage disequilibrium with rs11236164, respectively
  misc_feature [331]..[331]: n is a, t, c or g
ctccaacctgggcgacagagtgagactccgtctcaaaaaaaaggtaaattttatgtcatgaatattttactgcaatttaaaaattttaaataaaatttaaaaatttagctaaaaatggaccatagtcctgaatgtaaaagctaagactataaaactcttagaagaaagcaggggtaaatctttgtgaccttgggtttggaaaacctttcttagacacaacaccaaagcataagcaacaaaagataaattggacttcaaaggacactctcaaaaaacgaaaagacaacccacagaaagggcgaaaatatttgcaaatcatttttctgacaanagaattatatccagaatctataaagaacatttaaaactcaatagcgaaaggacaacccaactgaaaaattggcaaagggtctgaaaagacatttcttcaaagaatatatacaaatgaccaacaaacatcaaaacatcaacgtcgttagtcattagggaaaacattagtcattagggaaatgtaaatcaaaatctcaatgagaaataactttacacccactagaattgctgtaaacaaaaagagacaatagcaagtgttaatgtggatgtggataaatttggaaccttcatccacagctggtgggaatataaaatggtgcaggcactttgg

SEQ ID NO: 1405 - DNA, 661 bp, Homo sapiens
  misc_feature [331]..[331]: Chromosome 11, SNP identification no. = rs6592590
  misc_feature [331]..[331]: allele = t, in linkage disequilibrium with rs11236164, respectively
  misc_feature [331]..[331]: n is a, t, c or g
caggtggcccatgaatggtgctacccggcccccaagccacgttcaggagcatcacctcagggttaggcagggaagagaccatggctttatggcaaaattggccaggccaagtttctacggctccccaggtggccggcctcattagtgttgaggaccacattgggcctgccagaaccgcaggacaaagtccagtgcagaaggcttggggaaactgcttccagttctttccaggcccagagacacgtcccccaaatgcctggctggatataagcccctgcaatctgtgtgccagcccgggggcagtcccctcaattgcacctttaaggtggcnacactttccccaaatcttcctggccaaggctagagaggatcttagagaccttctagtccagctcctccattttcggttaaggaacctgaggcccagagcgggcaggaacttgctaaaggttagagtcggggagcttctctgaggcagcacaatggagctgggagcagaaatcaggtctctggcctcccagctgtccaaccctctgctccccactctctttcctcctgcctgttattttccagtctcttccccttggggctgctgccctctcccctccctcagagcttcctggccggccctactgctctgaggtccccacctgaggctacg

SEQ ID NO: 1406 - DNA, 661 bp, Homo sapiens
  misc_feature [331]..[331]: Chromosome 11, SNP identification no. = rs11822234
  misc_feature [331]..[331]: allele = t, in linkage disequilibrium with rs11236164, respectively
  misc_feature [331]..[331]: n is a, t, c or g
ggagcttcttaaacttcttgcttgggatggggttgggactagatctggttcatcttggtgtcccagcccccagttcagaactgaacatagaatgagtcggtaagtgttgattgaatgtcagcccaccccctacccaacacacacaaagatagataaggcctccatttacagagagaaaagcccaagaggagttttttgacctgtttaatgtcccagggtgagttagtatcaggacagggattagcatccagctctttgggagcttagactagttcttatgcacgaaggacagcattcatagagcagccagccaaagggacccactcaacanctgtgaaaagaagaggggggcagggaagaaaagaaacaaagggatcacttagcctgagccaaactgggcatattcattgtcaaatgctgttgtaacaaatcaccacatgggcgcggtgctcatgcctgtaatcccagcactttaagaggccaaggcaggcatatcacctgaggtcaaggagttcgagaccagcctggccaacgtgatgaaactccatctctactaaaaatacaaaaattagctgggcgtggtggtgcacacctgtaaccccagctacttgggaggctgaggcaggagaatcacttgaacccaggaggcagaggttgcagt

SEQ ID NO: 1407 - DNA, 661 bp, Homo sapiens
  misc_feature [331]..[331]: Chromosome 11, SNP identification no. = rs11602237
  misc_feature [331]..[331]: allele = a, in linkage disequilibrium with rs11236164, respectively
  misc_feature [331]..[331]: n is a, t, c or g
catctctactaaaaatacaaaaattagctgggcgtggtggtgcacacctgtaaccccagctacttgggaggctgaggcaggagaatcacttgaacccaggaggcagaggttgcagtgagctgagatcacgccactgcactccagcctgggcaacaagaccaaaactccatctaaaaaaaaaaaaaaaaaaaaaaaaaaaaaaaaaaaaaaaaaaaagcaccacacttaccggcttaaaacaacacgtatctattatcttacagccctgaggtcagaagttcagagtgggcctaactgggctaaaatcaaggcatcagtgggtctaccttcntttctggagactggaggggagactccatatccttgccttttctagcttctagaggctgcccgcattccttggctcatggcccccttcccttctcaaagccagtggccggttgggtagttctcacaagcatccctctgacacttcctcttctgtctccctcctcagttcataaggatctttgtgattatattgggctcatctagataatttgggataatctcatctcaaggttcagctgatctgcaactgtaattccctttaccatgtgacctaacatcctcaggttccagggactaggaagttgccatcttctttttttttttttttttg

SEQ ID NO: 1408 - DNA, 661 bp, Homo sapiens
  misc_feature [331]..[331]: Chromosome 11, SNP identification no. = rs7104802
  misc_feature [331]..[331]: allele = t, in linkage disequilibrium with rs11236164, respectively
  misc_feature [331]..[331]: n is a, t, c or g
tgaagaataaattatatgattaccctagtcacagactattagggcaggaagctcaagccttccattttgcagatgaggaaactgaggcagaaaggggcaagaatgtgcccagtgtcacacagctagtagcagagttgagactagaacctagatcttttgccaggaggaggacaggttggtgcccaattcagactgaaatatttcttgcatcaagaacacttcctagaggaagtggtaggcatagtcatcagtgatgataatagtgaagatgataatgatgaatttattgcacacttactgtgggccaggcattgtaaattaatgccaaatnctttagatgtattatttcatttggtcttcacatagggaaaccaatttatagtggttaagtgaccaaccagtaggcattgaatctaagtttcaaactcaaatctttcttattataaagtgaattatttcctctgtacttagagggttgttgggcttaggggcctaagaggattagaagctttactttggagaagcccagctttagggtagagatggagaatgatggcggggttggggatttattgagcctctgagtctatgagagaatggatatgaggatgcagtggctcaacgacttgtgtttaatttccactgaagactgaaattatgg

SEQ ID NO: 1409 - DNA, 661 bp, Homo sapiens
  misc_feature [331]..[331]: Chromosome 11, SNP identification no. = rs12789086
  misc_feature [331]..[331]: allele = g, in linkage disequilibrium with rs7939226, respectively
  misc_feature [331]..[331]: n is a, t, c or g
ttatctccggggctcaattgatcctcccaccttggcctcccaagcagctgggactacaggaacgtgccaccatgcctggcaatttttttaaaaatgtttgtagagacagggtctcactatgttgcccagaccggtcttgaacttttgtcctcaagccatcctcctgcctcggcctcccaaaatgttggtattacaggcatgagccactgcacctggccaagctcatagtctttttgaagagatagctgcatacatattggagatacagttcttgatggtgaggggtcggctgtgccaggatggggcttggggcactgggagctctgagatntgcaagtgagtcagctctggtcacaccacaggatcctcaggggttaaagctcaagattctgttctggatgcccatgcccagcacagggccagtcagggactgactatgaggcagcacccaccaacaaccctctttcaacagcctcacaggcagccaggggtgctgggaagaccaaaggcctcagactcagcttgtcctgggttctagcccaccttccccaactgtgacgttggacaagcctctcagccacctccctgagctctgtttcctcatgataaagtgagggcagaggacagcaacaccgagcaatggggttgatctactgatgct

SEQ ID NO: 1410 - DNA, 661 bp, Homo sapiens
  misc_feature [331]..[331]: Chromosome 11, SNP identification no. = rs17244949
  misc_feature [331]..[331]: allele = t, in linkage disequilibrium with rs11236164, respectively
  misc_feature [331]..[331]: n is a, t, c or g
caccacaggatcctcaggggttaaagctcaagattctgttctggatgcccatgcccagcacagggccagtcagggactgactatgaggcagcacccaccaacaaccctctttcaacagcctcacaggcagccaggggtgctgggaagaccaaaggcctcagactcagcttgtcctgggttctagcccaccttccccaactgtgacgttggacaagcctctcagccacctccctgagctctgtttcctcatgataaagtgagggcagaggacagcaacaccgagcaatggggttgatctactgatgctggcattatgtataaaacacattgntcagggctgccatcgagtcagtgcaccaaaatatggcagtgattatgtgtgtgtgaatctcatcatctcagacagactgtgagccctgggagggttgtgccggggccttgttctcttgaaccccctctccacccccaaatggagtcaagcacccaagggagactctcctgtatccattgaccgcatgacagaagaatctttttaacctgagggaggacagaggcaaggatttgccatttggtgttttcgtgcagataaggtcataaatgacgaatcacttgtaactggaggccgagtctccgtgtgttttccaatttgtgatctcattgt

SEQ ID NO: 1411 - DNA, 661 bp, Homo sapiens
  misc_feature [331]..[331]: Chromosome 11, SNP identification no. = rs11236208
  misc_feature [331]..[331]: allele = g, in linkage disequilibrium with rs7939226, respectively
  misc_feature [331]..[331]: n is a, t, c or g
agggaggacagaggcaaggatttgccatttggtgttttcgtgcagataaggtcataaatgacgaatcacttgtaactggaggccgagtctccgtgtgttttccaatttgtgatctcattgtattctcacagcccccgcctcctgccaacaccatgtcttgtgggaggatacggagaaactgggattggtctccccaatttccagatgggaaaattgagcttgggagagactgagtgacttatttaggtcaccctgcagttaatgccatggctggggcttctcccttccagcccaagggtttttgcaggagtccagtggcatgtttaggttnttcctgctacaaggaaaagagagcccctgaggtactgtggggacagtgagggagcacagaaggacttctccggtggcatggccttttgatggcagtgtctacactgcagccctgctggcctggtggctcctcagtgccctccaaagtagcagcagccctagctccttccccagcctcacgccaggtctgctgctctttccttcacacttgttgggtctcccacttaaaccccaaagagaaaggatctgtttgctagaccagtattttggatgcaaggggcacagactctctcagggcaccttgggagtagttctgggggacctgtgtggc

SEQ ID NO: 1412 - DNA, 661 bp, Homo sapiens
  misc_feature [331]..[331]: Chromosome 11, SNP identification no. = rs12282262
  misc_feature [331]..[331]: allele = c, in linkage disequilibrium with rs7939226, respectively
  misc_feature [331]..[331]: n is a, t, c or g
aagaagtgatgggtgctgggagggtataacttgctctgagctgagaactgaaggatgagtgggaatctcagtgaaaagtgagtgaaagacagaaccacagggtgggtgcaagtgcaaaggccactaagatttggtgattcaatgactatagaagccaggagattcttccaaacatgggggctcccaaggaagaagctcctatcttttcttggttcccacccatccacagagacctactcctctgccagcactggcaatactcggaccccacccccaatgcccagtgcagcccagaaaaggctttcctttcagggcagtgccactcccgcanactgagggaccctaatggcccaagctggaaggaagctcagagggcccccactggttcagtctaaggctccgcttcagtaccccggcgatgggagttcactctcaaagcgcagcttgataggcagtgagcgggctctgagcaggaacattctccccgatacacccacctcctgtgacccagctgccccgaaccctgctctccctctgctggactttaggccttgctctttcctttaaacccgtgagaccttgggcaaggtgttcaacctccctgggcctcatctgtaaaatggggatattaatagagccgggaggatgacataaaaccaag

SEQ ID NO: 1413 - DNA, 661 bp, Homo sapiens
  DLG2
  misc_feature [331]..[331]: Chromosome 11, SNP identification no. = rs790367
  misc_feature [331]..[331]: allele = t, in linkage disequilibrium with rs1454027, respectively
  misc_feature [331]..[331]: n is a, t, c or g
ttggttcactattttttctatgtaaacatcactctcagttatattttactgtgtttattgaggagtttattggaagattgaggagacaaagggcagagtaagagctgcatcatttaaagttgttttgaatattaagatgctttatttccttaaaaagtgtttgggtttcaacaaaattaggctctctcacggcagtgggttgtaaatgggttatggagtgtttcattggaataagaagttgaatattaatgaccttgacaatggtgattgtaacaaaagggagagggatctctgtttttggtattgggtgagggtgtccagctatagtagnatttttgtggctttctgaaagatgtttaaacaaatatagtctaagagtcacagggtcaatattatggccagatcaaggccgttgagacatggatttgaattatttgaggaaggttcaatatgtcctatactagtgtttaaactcttacacttttgtaaacctgcttttaaaggctttgtattgatttttaaaaaatttttaattgaactcataggataaatatagatctacaaaatgtcaggttagtagttactaagaatcgtgatggaaaaaaaattaagcatgaaataaataggaggaatcacataaaagatgagagatttgactaca

SEQ ID NO: 1414 - DNA, 661 bp, Homo sapiens
  DLG2
  misc_feature [331]..[331]: Chromosome 11, SNP identification no. = rs1599914
  misc_feature [331]..[331]: allele = g, in linkage disequilibrium with rs1454027, respectively
  misc_feature [331]..[331]: n is a, t, c or g
gaaacccagtctctactaaaaatataaaaaattagccgggcttggtggcgggtgcctgtagtcccagctactcggggaggctgaggcaggagaatggcctgaacctggaaggcggagtttgcagtgagccgagattgtgccaccgcactccagcctgggcgaaagagtgagactccatctcaaaaaaaaaaaaaaaaaaaaaaattgaaaccactgaagcaagaactcataaacaagcaataagctggggaaaacatttgctcaaatatatttatcaatattttaaagatgctcctacaactcaataagaaatgcaataacattttagtanaaaacaaagacaattagtatccaatcacaagagaaaatacaaatgacaaatacacacacacatataaataacctcactaggaataaaaataacacaaattaaatgatacatcccttttacctatttttaaaaaaaggatcttgaaattgacaaatcacaatttagttgtggtatgttgaaacagacactatattgctggtgctatggagtgtaaaacctccttaaaacatttcaagaaagcaatttggcaatatatttcaggagttttagaagtaatcctgtcttttggttcagcaattctactctagtgtgctatctgaagaagaaaaa

SEQ ID NO: 1415 - DNA, 661 bp, Homo sapiens
  DLG2
  misc_feature [331]..[331]: Chromosome 11, SNP identification no. = rs790372
  misc_feature [331]..[331]: allele = t, in linkage disequilibrium with rs1454027, respectively
  misc_feature [331]..[331]: n is a, t, c or g
atatcatttatgaatgatatgtctacataaaatttttatttgctcccactatttcatgttttctaaatgacattaagaattattaatgacataaactgagcaatagttataaatctgtatatatagtttgatgccaattttgtaagaggcatatctgtacatctgtaggttaatatggaaaagttaccaacatgttaatagtgctttctctgaatggcgggattatgggtacttttgatttccttaaatttttttttgtattttaaattaattttttaaaaatattttttgtaccccataaggggatagatcttgaatgttatcaccacanacacaaaaaaggtaactatgtgaggtaatgaatatgttaattagcttggtagtggtaatcatttcacaatgtgatatggtttggctgtgtccccaacaaaatctcatcttgaattcccatgtgttgtgggagggaccctgtgggaggtaactgaatcatgggggcaggtctttcctatgctgttctcatgatggtgaataagtctcatgagatctgaaagttttataagggggagtttccctgcacaagttctctctctttgcctgctgccatccttgccttctgccatgattgtgaggcttcctcagccacgtggaactgtaagtccat

SEQ ID NO: 1416 - DNA, 661 bp, Homo sapiens
  DLG2
  misc_feature [331]..[331]: Chromosome 11, SNP identification no. = rs1471687
  misc_feature [331]..[331]: allele = t, in linkage disequilibrium with rs1454027, respectively
  misc_feature [331]..[331]: n is a, t, c or g
ggttttttagatggtgaagtagaggagggaaatggttgaattctagattattacaagaatggagggtccccaaatttctcagtcactatatggtcacaaataccatcacctttaatctgtacaacaacaaactttcacggtggatattacatatagcttttgcataatggtggcacatggtggcgcacgcctataatcccagccactcaggaggctgaggcttcagaatcgcttgaactcgggaggcagagattgtagtgacccaagacttcatcattgcgctacagtctgggcaacagagggagactgtctcaaaaataaataaatacanaaataagtgggagggagtaggataactgaaatattaatgtgagttttgagcttcctgttttttcttcccaagtgtgaagcagataaccagacctttatattcccttgcctcagtagagatctgtaatacagaagaaaagcagaattttcccaaagacttctctcttccaggttttcgttcctcaaaaatctgagctcctaaactgttgatgctcagggtgagctctgagagaaaaggcaggcaagatagagcctattattatatatttggatttaaagaaaataaaataatgctctgtcaaaatgcatttatagagtgaagtgcatatcc

SEQ ID NO: 1417 - DNA, 661 bp, Homo sapiens
  DLG2
  misc_feature [331]..[331]: Chromosome 11, SNP identification no. = rs790351
  misc_feature [331]..[331]: allele = t, in linkage disequilibrium with rs1454027, respectively
  misc_feature [331]..[331]: n is a, t, c or g
taactgaaactttgtatcttttgactaatatcttcgtgtttcccccttgacatgtgcctagacttatccagttccaaaagtcatgctacttccttccacttaccttcctgcctctaaaaaaataaatatcttagaaatactagagttgaaaaaaattgaattacacaagattatgggtagggccttcaataatggacctttaaaaacaactgggattaatcaccataagttttataagttataatttggagactagttcccagatgttaagcctaatctatttacctcttattttctatatggactgtacattttatataatgttttatcncttgtagcttccatcacttaccagctgagtcagccttgggttagtcaacatcagttacctcacgtgtaaaagggggtaattatagctgcctcctggaattactatgcaaattaaccaatgtatatcaaagcactttgtaaactgaaaggtattacacaaatatcagttatcactattaccacaattcttatgaattctaagaagtatttaattaatatctgcttataactgaggatgttctggccctgaatattgtttgtaaaaaatacaagcaaatggccaggtgcagtggctcacgcctgtaatcccaggactttgggaggctgaggt

SEQ ID NO: 1418 - DNA, 661 bp, Homo sapiens
  DLG2
  misc_feature [331]..[331]: Chromosome 11, SNP identification no. = rs2449592
  misc_feature [331]..[331]: allele = t, in linkage disequilibrium with rs1454027, respectively
  misc_feature [331]..[331]: n is a, t, c or g
gatctttaatcatcaccactttctactttttattcaggtctcagtccatatgctatctcctgagagaggcactgcctggttatcctacttcatattgttctcttccccaatcactgctcatcacattatcctattttacttcctttgtagcacttagcactaactgaacttaatgcatttatttatacatctcttattcaatatactaaaatgtaaattccatgagggcaagcaccttgaccagtttgttcaccattgtgactatgttgctaataactatgcttgacatgggtagaagctgaatattcactgaatgagcaaataactgaangaaggagaaaaggcaacttgaatatatattagatgacatggctagtaagctagtgttctataattcggagacaatagagtagatgtggactccagactgatgagattatgtctgttcagtaagtgacagagtcaaactggtgaatattagagttacagtttggggcagttcttgtaaagtgtctgtggacaagaaatctttattgaggctttttttatatgatgctttttaatgaactaaatgatgtgagggaccaataagtagaggcagccagaaagacacactaaattcacagctaggtaaacttggtttctaacactgagaaatata

SEQ ID NO: 1419 - DNA, 661 bp, Homo sapiens
  DLG2
  misc_feature [331]..[331]: Chromosome 11, SNP identification no. = rs2449594
  misc_feature [331]..[331]: allele = a, in linkage disequilibrium with rs1454027, respectively
  misc_feature [331]..[331]: n is a, t, c or g
ctcctcagagtatggaaactacacagctcattagattatcagtgaaagagaaatgtggtcagtgcttattaaattgcaccttttgccatttttaaggtgggcagtgaaatgatccagaaaatattaccttcaacaacattttcatagagtgactttgctaacagagtcttcagaccacgaggaaaatttttagaccataaagcagaagttgagggaaaggtagtggtgagaaatggggaaagaggatactggggagaataataatagtggtttaaaatagtggtagttcactcagtttctatttggtgactgaaatattgaaaaatttacntagatttcagtcacagaacaggtggtattatgatactggcaacagaatgtagtgattaaaagcacatgcttttgagtcacgcatactgaagcttagaccctggtgcttcctagctgtgtgatttggggagacttgtttaaccttgtaagctttagttttgacatctgcaaaacaggaatgatagcagttactgcttcaaaaggctattgattaaaatgtgttggcctatataaagtgacaggcacaatacagttcttaatgttagctcttatcactaatactattgtcatcatctgtaagcaggatttcttggtgaaaattttcgctgat

SEQ ID NO: 1420 - DNA, 661 bp, Homo sapiens
  DLG2
  misc_feature [331]..[331]: Chromosome 11, SNP identification no. = rs2514171
  misc_feature [331]..[331]: allele = c, in linkage disequilibrium with rs1454027, respectively
  misc_feature [331]..[331]: n is a, t, c or g
acattagtattgaaaagtttcgtaaactcataaataagactcgaagtcgtgtcatagttagagacgacggttcgaagacgaagtccggggtggagagtgactgtggaggaggagtcgcatccgcccgtcgttcccttttctcacttggtgctaggcaagtaccacaagagaaaaatgtcctaccctttttctaaaacacacctttttgaaagtcaatttccgaaattagtccaagtctgaagggacacgaatacggacgtaaagaatacaactgtactctttagtgacgaacctctatacgttcttttaacctttctacttgggtcgaaanatattaactacattaggactttaagacatacacgcagttcactaacggtttgtccagtaaaaattaatgaactcgttaatccacgaatttaaaccgtacggaaaaagaaaatgatctcatgactttataagtgactaaaatgaaggaaaacactttactaatgaatgtaaaaagacacagtcgaaacaaatactgggtgtacgtcattacaaatcagaataagaattatcgggttgtaaggtgtcatccaccacaatattagtcgcaaaaccccactcttgatggttgagacaagtgactgaaataaaatattacctgatcaaacagtag

SEQ ID NO: 1421 - DNA, 661 bp, Homo sapiens
  DLG2
  misc_feature [331]..[331]: Chromosome 11, SNP identification no. = rs2449575
  misc_feature [331]..[331]: allele = t, in linkage disequilibrium with rs1454027, respectively
  misc_feature [331]..[331]: n is a, t, c or g
attactgaactaaataaaaatcactggatcttttttccataagcatactttaacaaaccatgcaagaaagggatcggggtaaaataatgcagtgagctacttcatcattcattaaaacaacactcaattccaggctatcttagtttcctagggctgcaataacaaagtactaaaaagtaagcatcgtaactaacagaaatttactatctcaaagttctgcaggctagaagaccaagatcaaggcattagcagggttgagtcctcctgaaagctataagagtaaatctattccatgcccctcttctggattctggtgatttgctggcagtanttggcactccttatctcatagatgcatcatcccgatctcagtcttcatcttcacatgaattctccctatgtgcatgtctgtttctgtgtccattttttttttttttttgtaaagacacttgccatattggaatagagtctaccagtacgacctcatcttaacttgaccgttagcaaagaccttagttccaaataaggtcatatacataggaatgggggttaagacatcaacatctttttcagggacgcaattcaactcataatactggaactgggaaacaaaaatatgaacagaatgcagttcctattgtcaaggatttcacagaccaat

SEQ ID NO: 1422 - DNA, 661 bp, Homo sapiens
  DLG2
  misc_feature [331]..[331]: Chromosome 11, SNP identification no. = rs1817515
  misc_feature [331]..[331]: allele = t, in linkage disequilibrium with rs1454027, respectively
  misc_feature [331]..[331]: n is a, t, c or g
aactaaaaattgagccactatatgattcagcgatcctacttatggctaccgaaagaaagcaaatcagtatactgaagcgatatctgcactctcatgcttattgcagcactatttacaatagctaagattttgaagcaacctaagtgtcgatcaacagatgaatggatacagaaaatatggtacacatacacaatggagaactattcagccacaaaaagaatgagatctagtcatttgcaacaatatgggtggaactggagatcattatgttaagtgaaataagcaagagacagaaagacaaacatctcatgttctcacttagttgtagganctaaaaaccaaatcaattgaactcatggacatacaatagaaagtaaaggatggttactagaggctgagaagggtagcagggagcttggtgggggaagtagggatggttaatatgtacaaataaatagaaagaatgaataagacctactatagtccaaaaagacaagtaaagtcaataataacttaatatttaaaaataacaaaaagagtataattggattgtttgcaactcaatggataaatgcttgagaggatggatatcccactctccatgatatgcttacttcgcgtgacatgcctgtatcaaaatatctcatgtaccccgtaaata

SEQ ID NO: 1423 - DNA, 661 bp, Homo sapiens
  DLG2
  misc_feature [331]..[331]: Chromosome 11, SNP identification no. = rs7933909
  misc_feature [331]..[331]: allele = t, in linkage disequilibrium with rs1454027, respectively
  misc_feature [331]..[331]: n is a, t, c or g
atcccagcattttgggaggctgaggtaggcagatcacttggggtcaggagaccagcctggccaacatggtgaaatcccatctctactaaaaatacaaaaaatttagctgggcatggtggtgcatgcctgtagtcccagctactcaggagtctgagggataagaattgcttgaacccaggaggcggagattgcagtgagccgagatggtgccactgcactccagcctgggtgacagagcaagactccatctcaaaaaaaaaaaaaaaaaaaaaaaaaaaaaaaaaaaaaaggtgtgccaaatagtccctcatacaaacaggaaacccaaatngtttatcaggaaagaagaggtgacaattttagatactgagaatattgaagtacttgccagaagtcagatttcaggctttgggaggccatggcgggtggatcacttgaggtcaggagttcgataccagcctggccaacatggtgaaaccctatctctactaaaaatacaaaaaaaattagctgggcatggtggtgtgcacctctaatcccagctactcgggaggctgaggcatgaagaatcacttgaacccgggaggtggaggtttcagtgagctgagatcccaccactgcactccagcctgggcgacagagtgagaccccatctcaaaaa

SEQ ID NO: 1424 - DNA, 661 bp, Homo sapiens
  DLG2
  misc_feature [331]..[331]: Chromosome 11, SNP identification no. = rs1483387
  misc_feature [331]..[331]: allele = t, in linkage disequilibrium with rs1454027, respectively
  misc_feature [331]..[331]: n is a, t, c or g
gggcatggtggtgtgcacctctaatcccagctactcgggaggctgaggcatgaagaatcacttgaacccgggaggtggaggtttcagtgagctgagatcccaccactgcactccagcctgggcgacagagtgagaccccatctcaaaaaaaagaaaaaaagaaagaaaggaatacaattaaagtggaggaggagcacactctggtcttggaattccatttgagaatttagaagtgtcatgtttataatttttcaattttgtttgttgttggcttgctgtaaagcaatataaaatatttttgttataaaataaataaaaaatacatcaaatnaggagcagcctaatgatggctgactagaggagttttgtacttgtctcctccacaccaaagaaccaaagtagtgagtagataatcacacttcgtatagttccctgaagagaaaatactggaatgtaataaattcaacagaaaagtgacacaaaatacctaaagcaaagaagaaaaaggaagcaaggcatcctgcttgaccaggatcagctgggagatgagagactcctcaatatgggagaagtataaatgagacatctttagtggtccacattcccactgtggactcctgcaatcctagacatgggagaacccctcaactcttgtgggtcc

SEQ ID NO: 1425 - DNA, 661 bp, Homo sapiens
  DLG2
  misc_feature [331]..[331]: Chromosome 11, SNP identification no. = rs1586143
  misc_feature [331]..[331]: allele = t, in linkage disequilibrium with rs1454027, respectively
  misc_feature [331]..[331]: n is a, t, c or g
agcatcaaaagtgtctagtcacctacaagggaatctccactagactaaaattggtttctcagtagaaaccataccgggcaggaggaaatgcaatgatatattaaaagtttcaaaagaaaaactgccagccaatgatactatgtacagaaaaattatccttaataaattaagaaaaaataaagtcttttacaaagaagcaaaaacaagaaattcaacaccactagaccagctctataagaaatgctcaagggagtcctaaacctggaaggaaaaggacacatctgccattatgaaaacacacaaatgtataaaactcactggtaaagcacanatacaaaggaaaaagagaaagaactcaaatagcatcatgacagaaagctaccaaaccaaaatggaaaacaataaaagaaaaataaaggaacaaagaacatacagaacaaccaaaacacaattaacaatatgacaggaacaaaacctcatatattaatattaaccttgaatgtaaacagattaaattctttacttaaaagatatagactggctgaaaggttacaaaaacatgatccaactatatgctgcctataagaaacatactttacctataaaaacacatgaagacacaaaataaagggatgaaaaaagatattccataataacagaa

SEQ ID NO: 1426 - DNA, 661 bp, Homo sapiens
  DLG2
  misc_feature [331]..[331]: Chromosome 11, SNP identification no. = rs1118277
  misc_feature [331]..[331]: allele = t, in linkage disequilibrium with rs1454027, respectively
  misc_feature [331]..[331]: n is a, t, c or g
actcaaatagcatcatgacagaaagctaccaaaccaaaatggaaaacaataaaagaaaaataaaggaacaaagaacatacagaacaaccaaaacacaattaacaatatgacaggaacaaaacctcatatattaatattaaccttgaatgtaaacagattaaattctttacttaaaagatatagactggctgaaaggttacaaaaacatgatccaactatatgctgcctataagaaacatactttacctataaaaacacatgaagacacaaaataaagggatgaaaaaagatattccataataacagaaaccaaaagtgagtaagagtagcnatccttatattggataaaacagacttcaagtaaaaaaaaaaaaacagtaaaaaagagaaatcagaaaattatataatgataatagggaatcaatgcagcaagagaatgtaacaatgctaaatatacatgcacccagcactggatcacccagattcataatacaaatattactagttctgaagagaaagatagattctaatacaataatagtggggtacttcaatatcccactcggcattagacagatcatttacacagaaaattaacaaagaaacattaaagtagactttagataaaatggacctaacatacatttgcagaacattttat

SEQ ID NO: 1427 - DNA, 661 bp, Homo sapiens
  DLG2
  misc_feature [331]..[331]: Chromosome 11, SNP identification no. = rs1304480
  misc_feature [331]..[331]: allele = a, in linkage disequilibrium with rs1454027, respectively
  misc_feature [331]..[331]: n is a, t, c or g
catggaaattaaacatgttcatgttcttaaataatcattgggtcaacatagaaattaagatgaaaatcaaaaaagttcttaaaacaattgaaaatgaaaatacaacataccaaaatctgtaagatacagcaaaagcagtactaagagggaattttatagcaataaacatcataaacaatctaaaaatgcaactcaagcaattagaaaagcaagaacaaacccatccccaaattaaccgaaatagagaaataataaagataagagtagaactaaacaaaataggtttaaagaacaatataagggtcaacaaaatgacatattggttcttcanaaagagaaaattgataaactaccacctaaaatagcaaagaagagagaacacctaaataaacaaaatcagaaaagaaagaggagacacgaccattgatacatgcattagtctgttttcatactgctatagataacttcccaagactgggatctaccatcctagggtctggaggatgggggccctcttcttacagctcaactaggtagtaccccagtggggactctgtgtgggggtgcccacccgacatttcccttccctattgccctatcataggttctccatgagggctcctctcccacagcaaacttctgcctggacatccaggcattt

SEQ ID NO: 1428 - DNA, 661 bp, Homo sapiens
  DLG2
  misc_feature [331]..[331]: Chromosome 11, SNP identification no. = rs2170707
  misc_feature [331]..[331]: allele = t, in linkage disequilibrium with rs1454027, respectively
  misc_feature [331]..[331]: n is a, t, c or g
ataataaaaataatctggatctacatttctgagggtaaggaaaaagcttagtccttcagtgacagctttgcccattaagaaatgaaacaatgaatgtggccaaatatagcatttggaccatgctatgctctatgagtacaagagagttaaaaccttggcactaaaaaacactaccaccctttagtgctaatgttttctggtcatcaaataaagaaatacatgtccatagcacatttattttttaatttttaaaattaaaaaattacatgtgtttcaattcaaagctataaaaatataatgtggattgtattgtttataaaatccttcaatnaattggattttggagcaatagtttgctagatgaagattgttttttaccctgattaaaatccaaaatgggatattctctgtgagacttacatatatagaaaataacaaaacagatttcctagcatttaaatggatagttcgcttgcttttcaagactaacaaaatctgctaatgctatattttgaagtttatcaacctatgtctaagaataaataatttccacaatacagtagtagctgtcatgaaacattttagttattgtttctctggtctcaggcttttgcaagtgtccttatgtactccagatcattgtgtactatttgtaagacag

SEQ ID NO: 1429 - DNA, 661 bp, Homo sapiens
  DLG2
  misc_feature [331]..[331]: Chromosome 11, SNP identification no. = rs1483388
  misc_feature [331]..[331]: allele = g, in linkage disequilibrium with rs1454027, respectively
  misc_feature [331]..[331]: n is a, t, c or g
tggttggatcatgaggtcagaagttcgagatcagcctggccaatgtggtgaaaccccatctctactaaaaatacaaaaatcagctgggtatggtggtgcacgcctgtaattccagctacttgggaggctgaggcaggagaattccttgaaccagggagatagaggttgcagtgagctgagtttgcaccactgagctccaacctgggtgacagagtgggactgcgtctcaaaaaaaaaaaaaaaaaaaaaaaagctcccctacttcagttaaaaacttccttaattaaccaaaactcataactgtcttgactggacctggagatgctaactnctcatggctagaaagctgctcttgagtatatcttcacaatgctctgcaaacaagtagagttgtacacttaccaaatagaattgtatacatacctagtagagttgtgtatttatcaagattcatctgagttttttacctaacccatttatctccctttaacttgttaattatgtcagctgctgttgctgttgctgtaattatgtaatttgattaaatattttgtgaagtgataaaatactcatcttaatgtttctataaaatgtaaggtgaatgttttggaaaggcttgtgaaacaccaaatgtttaaaacatgctattaatgtgggcaag

SEQ ID NO: 1430 - DNA, 661 bp, Homo sapiens
  DLG2
  misc_feature [331]..[331]: Chromosome 11, SNP identification no. = rs2514167
  misc_feature [331]..[331]: allele = t, in linkage disequilibrium with rs1454027, respectively
  misc_feature [331]..[331]: n is a, t, c or g
atacaaaactgtgaataaataacttatccacttactaatttacatgttttaggttattacttacgataagatgttttcatttccacttttttagttacactccaccaaagaaacccttgttaaaaaaccttctttaattactcatagatgtggtttaatgcatacataagtttacccatttggctccttcccctgaaaggtcttgttcttcattgtaagagctcccacctctatacgacacatctacaaccggaaaaaaaatagagttttgattaatatgtcttttttttttttcagacatagtcctaatcctacatccgtccacgtgganacgttctttgtagtaactaaaatataacctaacactttctctttcatgtaacattttagtacggaaagtattgtcgcctaaccttacgggagaaggactaaataatcgacacccttgtgtttgtacaacaacttgaaaagattctgagtaatgtacaattcaacatcattatcaaccgggttcctaatttattttgatacgtccgttaagaaagtctgttacacggaccgtgtaccatgcatcagttattcttgagtaaacacattatccttgttctgatcaactggtctaaccagtctatgtctcttctaagaaatttgtaaaataaaa

SEQ ID NO: 1431 - DNA, 661 bp, Homo sapiens
  DLG2
  misc_feature [331]..[331]: Chromosome 11, SNP identification no. = rs2514166
  misc_feature [331]..[331]: allele = t, in linkage disequilibrium with rs1454027, respectively
  misc_feature [331]..[331]: n is a, t, c or g
acattttccaattatgtgtgttcagaatcttttcacggaccgttactatcacgattcagtcactcacgattatctcgaaagtatgcattagtagaaagatgaaccgtgtacgaagaaatataaatcactagttgattattaatactacacttacttaattcggtatcatcggagacgaatatttaacaaacattttagttagattaattataaataactcatgactcttatacaaaactgtgaataaataacttatccacttactaatttacatgttttaggttattacttacgataagatgttttcatttccacttttttagttacactncaccaaagaaacccttgttaaaaaaccttctttaattactcatagatgtggtttaatgcatacataagtttacccatttggctccttcccctgaaaggtcttgttcttcattgtaagagctcccacctctatacgacacatctacaaccggaaaaaaaatagagttttgattaatatgtcttttttttttttcagacatagtcctaatcctacatccgtccacgtggacacgttctttgtagtaactaaaatataacctaacactttctctttcatgtaacattttagtacggaaagtattgtcgcctaaccttacgggagaaggactaa

SEQ ID NO: 1432 - DNA, 661 bp, Homo sapiens
  DLG2
  misc_feature [331]..[331]: Chromosome 11, SNP identification no. = rs10751101
  misc_feature [331]..[331]: allele = a, in linkage disequilibrium with rs1454027, respectively
  misc_feature [331]..[331]: n is a, t, c or g
ggattgctaggttgaattcttttggccctaggtctttgaggaatcctcacactgtcttccacaatggttgaactaatttacactcccaccaacagtgtaaaagcattcctttttctccacagcctcatcagcagctgttgtttttttgcctttgaataatagccattctgactggtgtgagatggtatctctttgcggtttttatttgcgtttctctaatgatcagggatgttgagcttttttttcatgtttgttggccacacctctgtcttcctttgagaaatgtctgctcatgtcctttgtccactttttaatgtggttatttttttcntgtaaacttgtttaagttccttacagatactggatattagagctttgttagatagatagattgtaaaatttttctcctattctgtaggttgtctgtttactctgttgatagtttcttatatcccatatgtcaatttttgcatttgttgcaattacttttggtgtcttcatcataaaatgtttcctcatgcctatgtcttgaatggtattgcctaggttgtctttgagggcttttatagttttgggttttacatttaagtcctgaatccatcttgagttgatttttgtatatggtataaggaaggggtccagtttcaattttctgcctatg

SEQ ID NO: 1433 - DNA, 661 bp, Homo sapiens
  DLG2
  misc_feature [331]..[331]: Chromosome 11, SNP identification no. = rs2853026
  misc_feature [331]..[331]: allele = c, in linkage disequilibrium with rs1454027, respectively
  misc_feature [331]..[331]: n is a, t, c or g
cttttctcgtaccagtcttgtctcgtgtccggatttggatcacttcacactctcttcaacgttctccgtatcgacctgtctattcacccggtcttctgtccgctctcaggaccctggacggtgaatctcaacacacctgaaaataataataataacgaagagtttatacgttatacataaaaatgacataataagtatagtgaacaaagggaaagtagccatttcgagtaggtgaggttgattatgagatactaaatagagagaacctcctcctcacgtgagggaaggatgggtacagggtaaaatcgtatactggaatttaaaagcgagngaaaactctaaaaaaaaagagtaaagacgtttctcacacttaaagtaatcctgttcctttacacctactacacaggaaacgaagacataccactcgtaagttgaccattaacttgtaactagaataaatgtaattctaaacctatcttcatcccataattagactcatatttcttctctaatatgatagaaaaaataaccaccagtcacaaaacttcgtaaaagaaaataaagaccgtctgaggtgttaaggttatccttttatcattgactaactcgaagatcaaaaattaggacttttcttttatgattaaacttttctttatatcca

SEQ ID NO: 1434 - DNA, 661 bp, Homo sapiens
  DLG2
  misc_feature [331]..[331]: Chromosome 11, SNP identification no. = rs1601094
  misc_feature [331]..[331]: allele = a, in linkage disequilibrium with rs1454027, respectively
  misc_feature [331]..[331]: n is a, t, c or g
atgatttctctgctccctctttccagtgaaatattctttcaaaaacatagtacaggcctatctcattttattgcccttctctttagtatacttcacagataccacattttttacaaattgaaagtttgtgctaaccctgcatcaagcatgtctattggcaccatttttccaacagtgtgtgttcacttcacgtcgtgtgtcacattttttttggtaattctcatagtatttcaaaatttttaatgattattatatctgatatagtaacatgtgatcagtggtcattgatgttactatcacaatagttttggggtgccacagaatatgcccntataagatgatgaacttaactgataaatgtgtgtgttcttactctaccaaaaatatgtccttacctgttctcgctccctcttcttgggcttaccctattccccaagaccccgaggctaaataataacccttaaatggcctccaaatgttcaattgaaaggagtaatcacacacatatcctttaaatcaaaatctagaaatgattatgcttagtgaggaaggcatgttgaaagctgaggtaggtagaaagctaggcctcctatgccaaacagccaagttgtaaatacaaaggaagagttcttgaaggaaattgaaagtgtgactccattga

SEQ ID NO: 1435 - DNA, 661 bp, Homo sapiens
  DLG2
  misc_feature [331]..[331]: Chromosome 11, SNP identification no. = rs1160818
  misc_feature [331]..[331]: allele = g, in linkage disequilibrium with rs1454027, respectively
  misc_feature [331]..[331]: n is a, t, c or g
cttctctcgaacatgtccctttgagggtcaaaattttggtagtctagagtactctgagtaagtgatagtgttcttgtagtgtcctttctgggtaggggtattaagttagtggcgggtggtcaaaggagggtattgtgtacccttaacacccttaatgtaaagttctaccttaaacccacccctgtatcggtttggtatagttgtatgttttttgtaaagatataaatttatatttacaaataaaatttttactttcgcatgttgatatttcctttaacccatttaactggatataattttaatcctttaagataagtaatttactacagtnactgtctcattttgtccttctgtatctcacctcttttataagggtcatttaaatagtatgtaaatatattacaagtcggaataagtattattttattaacgttcaattttcatgttctacggtaaaaaaattgatagtttaacgggtgtaagtttttaacactgctacgtgacacaatcctccacaccattttctccgagaaagactctcgacttcctccgaccacctcatatttaacaaggtataagaacctctcgttatggttttatagaaattgaaatattgacgaatttgggaaaccgtatcactaagatgaagatccttaaatag

SEQ ID NO: 1436 - DNA, 661 bp, Homo sapiens
  DLG2
  misc_feature [331]..[331]: Chromosome 11, SNP identification no. = rs7114261
  misc_feature [331]..[331]: allele = c, in linkage disequilibrium with rs1454027, respectively
  misc_feature [331]..[331]: n is a, t, c or g
tcaccctattattttcttcatgtcctttatcaccatctacccttattttgttaactgcatatatattgtatgagtacctcactagagtataagctccaggaggcaggaacctttctgtcattttcaccactaactgtattctcgtttctagaacagcaccagacacataataaacattcaataaatatgtgtttaagaaatgagtgtctcaatcagtaagaagcggtaatagagtgaaaagtgtataagttttagagttcacagactggaatttcattcctgctatgagctcaatatgtccaccaaattcgtgtgttggaaacttaatccncagtgcaagagcactggcaagtggggccttttgggaggtaagatgatcctggactttatttattaagtgtgtgaccttgggctagcttcttaacttctcttaaattcctcattttaaaacagtgattgttaaactcttgtgaagaatgatgttttcaaatgtaaaagcattcgatactgtttagcacataaaaggtactcaataaaaaggatatccctgtcctgctcaatcgaaatactttccatgttttgttagtccattctcaagtggctaataaagacatatctgagactgggtaatttatgaaggaaagagatttaatggactcac

SEQ ID NO: 1437 - DNA, 661 bp, Homo sapiens
  DLG2
  misc_feature [331]..[331]: Chromosome 11, SNP identification no. = rs7108582
  misc_feature [331]..[331]: allele = a, in linkage disequilibrium with rs1454027, respectively
  misc_feature [331]..[331]: n is a, t, c or g
aaaaattcctctgatatgaaatgcctcctactgactttgtactggaacatttattttctttgtgtggaagatgtaggcagcatactttgcattaactgattatttggaggtatggctggaaggaggggactaggaagagaattggcttgatgcctgaactaatttcaacttcatttcatccaaaggcaaagggaagaattggccagtctttcagtgaggtggatattctttttcactcctcaaaaaagtagataattctcaagtgtgcctaatgtctgtaaggctcatttgacattccatcccccatttatcaactataaaaccttgtccnttgtctcggtatttcaccatgttaaaaggtatttacataccagtatgcaacctgaaaatagataaactaagtagacccaaatggaaaaaagggtaggcattgaatcactcaagaaagctgctatcttgtctaccccatttatttcttttagccccagggcaaaaatttttaaaagacagtggttgaattatattaaaggggatacaccggtagtaatttagcattcattcttttaaagttgttcttcacaatgactctgagaaaggttgtagcagtatcactgcatcaaaaataaagcggggaaaaagcccagataaattaaatagtggt

SEQ ID NO: 1438 - DNA, 661 bp, Homo sapiens
  DLG2
  misc_feature [331]..[331]: Chromosome 11, SNP identification no. = rs1945828
  misc_feature [331]..[331]: allele = g, in linkage disequilibrium with rs1454027, respectively
  misc_feature [331]..[331]: n is a, t, c or g
tgattgtatctctttgaggcagagatgacttttatgttttaatcggcccgtaccaccgtgtacggacattagagtcgatgagtccaccgactccgtcctcttagcgaacttgggacctccgtttacaacgccattcggttctagtgcggtaacgtgaggtcggacccgttgttctcgctttgtgggagagttttttttttttttttttttcacttttgttcaataaagagttgtttatactaaagaatagtgtaaatgcgtttttttacaaccgtgataaattcacggtacagatttctgttatttagatcaaacaaaccgtctaagttanaaagttttattctataggtactctctagtttattagtttctccagggactaataccttcagatcctggagaaactgtacatggcacaccctgacgataacagttcaaataccatttctttctctcttttacccttcctctctctaggaagtgatttgtaaacaattcgcagatagtactgtctttggaaataaggtgttatttctaggtctctacttatgtttaataaaaggtgggacgatctctctaatcactccatttataagttgtttataacacaaagaaatacatcgttgactatactatcttcgcactcttactccaagaaatc

SEQ ID NO: 1439 - DNA, 661 bp, Homo sapiens
  DLG2
  misc_feature [331]..[331]: Chromosome 11, SNP identification no. = rs1945824
  misc_feature [331]..[331]: allele = g, in linkage disequilibrium with rs1454027, respectively
  misc_feature [331]..[331]: n is a, t, c or g
gtgtgtctattgttttctccagagaactctgttctgatgtacactacattaagataaaaatagacccttcctctctggaagtttagaaaccaccacccttgacatggatcaagggacgactgacccactgaaccttaattggtccaatcttctgtgacacacacacggatcaacccacaagtcttctattcttcgattcgaaatttatacttacacgaaaactcgtaacagttcgggactttattgtacgactgatatgggtaggtgactcaaggtcatctatggatccgaaattatttatcgtgaagaattgggtttaactttaatgganataagaaaacacactcggattcttttatcaggttccttcatttgacataacaacgacactgtactattaacgttttacttagacaaataaggaaggaggagtccttctgacaaagatggattcaaagactaacctagtcttcgagagggatctacaatgacatcgtgggttccagtaaagtgcgatacagtactatcggacaaaggatccgtcagtggggtaaggaagggacacgagttgatctcgaggaactcccatcatagaaaacatcgacttaagggtcgtagattggctcatgtccgtgtatcattctttatggacttccttctt

SEQ ID NO: 1440 - DNA, 661 bp, Homo sapiens
  DLG2
  misc_feature [331]..[331]: Chromosome 11, SNP identification no. = rs10501555
  misc_feature [331]..[331]: allele = a, in linkage disequilibrium with rs1454027, respectively
  misc_feature [331]..[331]: n is a, t, c or g
tagtaagtacatgagacaaaaagatgaacaggacgtgactggctagaactgagatttttaaacaaaatatgaccgtaaacagtgggtcagaaactttgcagttggctaaaagttaattgtgcttatggtcaaggcaaagtctctggagagctctacgtggcatgggaagtagataatagtactttgttaaaacatagtgtactctcattcatgctcaataaaacaggagattcatttgctgggagctgaaagatctattgcacttactctactcatacaaagtaggaggtaaaaatgtctcactgcatttttcttttggaatttctaccanggattctggcctattcaagggaacctcatgccaaatgcagaactgaagggaggaggcacagcagaaaaaaaacactacaaactattccacaggctcattctaaccagattgtggtcccagggcaggaaagggggagcttttgatgagaatcacagattttctggtatgcagtatgtctttggctacaactgtgtaggttgtggcaacttaccagacagccagaaaattctgtggtggcttggggcctggcaattcagtggtggcttctaaatctttagaaggctcaactttctcttgaggttttgaaactatgcagctttgacatgcctc

SEQ ID NO: 1441 - DNA, 661 bp, Homo sapiens
  DLG2
  misc_feature [331]..[331]: Chromosome 11, SNP identification no. = rs1014066
  misc_feature [331]..[331]: allele = t, in linkage disequilibrium with rs1454027, respectively
  misc_feature [331]..[331]: n is a, t, c or g
caatcttatactagttacttaatcactcaacaccacagtatgcaaaatagatatgacaataattacttcagagttgctgcaaggaggattaggtaaggtaatacaatggatggatttaacaacaaagatcagatttccagaacatttggggaaaaaattcccttcttattcagaacagccaagtctgagtgatgcataggttgtccaggcagagcagtatgctgcatttcaactgcatctgaaagtgttgccaaaggatttgatcagttcacctaggagcatcctcgaggttccaccaaacatgataggtcaaacgtgtgttgtaatgtcnatcaaaccaaacaggctgaagacagcccgtccctaaagtaatatgcttgaagagaaggggattaactaacactgacacaagtttaattttgaagcagtaataaatagttctcacaaaatattttgtcacctggatattttatcattgaattcaggaatagagaaacatactacaactaggaaacattcactttaggccaggcacggtggttcacgcccataatcccagaacttcgggagtctggggcgggcagatcactttatgtcaggagttcgagatgagcctggccaacatggtgaaactccatctctactaaaaatacaaaaatta

SEQ ID NO: 1442 - DNA, 661 bp, Homo sapiens
  DLG2
  misc_feature [331]..[331]: Chromosome 11, SNP identification no. = rs2000961
  misc_feature [331]..[331]: allele = t, in linkage disequilibrium with rs1454027, respectively
  misc_feature [331]..[331]: n is a, t, c or g
ttgaagaatctgtacgaaattttacaggtagagactgtctataaaagaggggaaagaatcagttgtattagtaaggagtgggatgggtgggggttaaaacctttggagtgagaacaagagaagaagtagttctgaaacacgaaaacatctcttaaggacaagaggtaacatggaataggggtttgggaaattaaaagattgcacaaataatccaaaacttttgttttcgtccctttagaaatgtccgacgaagactcaagttgggacgaagagggacgaaggaggatgttacttatggacgaagtcacccttctttccttttcctttttgngtgtctcttcattatttttgtgatcatcgagctttatctcggatcaatgtgtctctacatgtaatcctttttgactttaataaagttcgtaaactcgttaacaatcttaagtctcaaatgttcgaatataaaataggtaaatggaactacaactactcggactacgtaaaatttgagagtttaatagataacaaacttccttttcttacatacataatacttttatccgtaattttggacaaaccacttaatgcaccaaaatttcaaattctacaaaccagatatatctgaatcgaatttaatttttacgtgtacatcagtaaatctttt

SEQ ID NO: 1443 - DNA, 661 bp, Homo sapiens
  DLG2
  misc_feature [331]..[331]: Chromosome 11, SNP identification no. = rs1584854
  misc_feature [331]..[331]: allele = a, in linkage disequilibrium with rs1454027, respectively
  misc_feature [331]..[331]: n is a, t, c or g
catttaatgctataaacttttctgttaacactgctttcactgaatcctagagattttagtatgtcacagctctgttttcattaatttcaaagaattttttatttctgccttaatgttattattcacccaaaagtcattcaggaataagttgtttaattcctatgtaattgtgtggttttgagagatcttcttggttttgatttctatttttattgcactgtagtttgagagtatgtttggtatgatttttatttctttgcatttattgagtcttgctttaccagtaaagcatgtagtagatcttggagtgtgttccatatacagacaagangaatgtactttctatcaatgttggatagaatattatgtagatgtttattaggtccaattggtcaagtgtctagtttaagttcatgattcctttcttagtttgctgcattgatgatctatctaatactgtcagtagaatgttgaagtctcccactattattatgtggctaagtattttcatagatctagaagtacctgttttacaaactgggtgctccaatgtttggtatgtatatatttaggatagttaagtcctctttgaattgaactcttcattatcatataatgcccttctttgtcacttttgacttgttattttaaaatctgtttg

SEQ ID NO: 1444 - DNA, 661 bp, Homo sapiens
  DLG2
  misc_feature [331]..[331]: Chromosome 11, SNP identification no. = rs1598073
  misc_feature [331]..[331]: allele = g, in linkage disequilibrium with rs1454027, respectively
  misc_feature [331]..[331]: n is a, t, c or g
cttgtatggctgatctggtggtaacaaattcccttacgcttgtctggaaaggattttatttctcctttgtgtatgaaacttagtttggctggatatgaaattcttggttggaatgtcttttctttgaggatactgaaaacagaccctcaatctcttctggcttgtaaggtttctgctgagaagtctgctgttagcttgatgaaatttcctttgtaagtgacctgaccctttttcctaggtgcctgtaagattttttctttcatgttaatcttggagaatctgatgactttgtttcttggggttggtcatcttgtatagtatcttgcagcgnttttctgtatttcttgaatttgcctgtcaacctctctagtgaaactggggacatgttcatgaattatatcctcaaatacattttccaagttgtttactctttctccttctctcttgggaataccagcatgggttgtagtttagttctccttacataatcccatatttcttggaggttttgctcattaaaaaaaaatattttttctttatttttgtctgactgtgttgattcaaaagaccagtctttcagcttgagattctttcctcagcttggtctattacattgctaatgcttgcaactatactatgaaattcctgtagtgaatttttc

SEQ ID NO: 1445 - DNA, 661 bp, Homo sapiens
  DLG2
  misc_feature [331]..[331]: Chromosome 11, SNP identification no. = rs1454019
  misc_feature [331]..[331]: allele = g, in linkage disequilibrium with rs1454027, respectively
  misc_feature [331]..[331]: n is a, t, c or g
tatgtagttcaaggtcacttgaccagaaagtgctagagccagaattcaaacctggattcaaaccaggccatgtgcgtctatgttactgtccttccagtaatacaaccaggccaacttcatttagatgccaaccactccctgagtatacactaaatttcagatgttgttctagaaaaattgtatataaatcactttatatttatatactgcatatatttacaggaaggaatagatgttaacaaaataaactataaataaataatatacatttcagatactggtgagtgcaattaagtaataataaaatgggaaaaaagaatgatggaaatgntactaatttaattacagtgaacagggaagatttttctaaggtgatgatatttgagcagatatttaaataataaaaagaataaaccatgtaaagatataacggacaatttttccaggcagctagaataacatacatatagggcttgagttaggaaaagcttggcttgtttgagaaacgtcaaggtcaccgtggctagagtgaaatttatgaagagttggtggtgagcacataatgttggagagaggagcaggtgtcacattacagaaggccttgtatgtaatgataatgaagttaattatcacctttggaaggtcttaagaatataagtgg

SEQ ID NO: 1446 - DNA, 661 bp, Homo sapiens
  DLG2
  misc_feature [331]..[331]: Chromosome 11, SNP identification no. = rs1869472
  misc_feature [331]..[331]: allele = a, in linkage disequilibrium with rs1454027, respectively
  misc_feature [331]..[331]: n is a, t, c or g
tatctacagtaattcacccctaaccataatcttgtgtatcctcactcagcaaaaccaaaactgttataaatggctcccatcatcttttgggtggtttgcaaacaatccattgttgtttgaacttgccttggtgtctcatataatattcccaatcaggttatcgacatatgattttcaattccttttcctcaaaagagttcggccgaatacattttttttcttgtacagtaacacttacggtaatatttaagtaccttggtcatattttatgctactgatagtttggggcccggagagcttcacagttggggtttctgttattccagttctngccctaactgtcacagcctcctctctactttgagaactagaaaaatcagaggattgacattttcatagacttggagagtcagtcaaatagattaaacttttcagtgtttgaaaaatgtgtgtgcatgtttaagatacttgatttttctgaactttatggttctgtggtgacagctggtagatttctctggtggccagaaaatcaaactgatgtcacacattgtcctgtgctgttctgagcatgtagccttcctagaatcatatggcagttaagcaaagagagtgacccacagccaactcaaatttaaacttggtatttaatttaaagctc

SEQ ID NO: 1447 - DNA, 661 bp, Homo sapiens
  DLG2
  misc_feature [331]..[331]: Chromosome 11, SNP identification no. = rs1454027
  misc_feature [331]..[331]: allele = c, t
  misc_feature [331]..[331]: n is a, t, c or g
ctctctctcttttcttttcttttctttcctttcctttccattcccttcctttccttttcttttcttttcttttattttctttcttttcatatcttcttggaataggaagactcaaaagggtaccagaaaaattttcacttgcattctattaattaaactacagatactcctttaatatagtaaacaaatgttaatcagacaacaaacttacagcaaaaagcaccaaggattgaaagcagttggtagggcagggagaagagatggaagaaaattcaaatcatgttttcattatactctttgttttcttaatcatcctctgcttaggatggtnttgcttgccaagttttccctgtataactcctacttagcctttaaaaacatcttccatgattctcctctccttccatctaatatcatcacaaaccctgcctttctttctctagccctcctacgcactctaatacacacatatgcatgcacatatatacacaggccaggctctgctaatgctgtttctctgtgtttacagactacttctgtagattctttttgctctgattatattatcaggctgtgttaagtatcagctcaggctttggattcagtcagacatgtaggctaatcctaaattggcctcttaataatttttgtgactttagaa

SEQ ID NO: 1448 - DNA, 661 bp, Homo sapiens
  DLG2
  misc_feature [331]..[331]: Chromosome 11, SNP identification no. = rs970226
  misc_feature [331]..[331]: allele = t, in linkage disequilibrium with rs1454027, respectively
  misc_feature [331]..[331]: n is a, t, c or g
cagaagcaatatttgaggcaataatgactgaaaatttcacccaaattaatgtcagacaacaaatcacagatccaggaacctcagagaacaccaagcagaataaatgacaaagcaaacaaacacacaagcaaacaaaaaatcctcctactcccaataactggcatctaggcataccatattcaaacttcagaaaatcaaggatttttttaaagtcttgaaagaagctagtgggggcaggtgggagccatatctacggaggagcaaagataaaaattatatctgaacccccccagaaaccatgcaaactggaagagagtgaagtgaaatattnaaagtgtggggagaaaaagaccaaagtaaaaatttataaaattatccttcaagaatgaaaaagaaaagacttcctcagacaaacaaaaattaaggaaatgtttctgtcagtagacctatcttgagagaaatattgcagtaagtacttcggagagaagaaaaatcataaaggtcagaaacattgatctacataaagaaagaaagagctctggagaaagaatatatgaaaataaaacaaaataaaagttttatttttcttaatctaacagataacagtttgttcaaaataataataggaataatgcatatgattatatatgtgcttatatat

SEQ ID NO: 1449 - DNA, 661 bp, Homo sapiens
  DLG2
  misc_feature [331]..[331]: Chromosome 11, SNP identification no. = rs1670685
  misc_feature [331]..[331]: allele = t, in linkage disequilibrium with rs1454027, respectively
  misc_feature [331]..[331]: n is a, t, c or g
catgtcacttataatcatgtatgattatatataagtgaaatgaataatacaagaaactatggcagaatggggaatattttgttataagacacttgtactatttgtgaagtggtggagtgttatttgaaagtgaacttggattggttgtaaatgtgtagtgcaaattctatggcaaccattgaaaaagtaaaagaagaagtataattgatatattaataaagaaaataaataatataaaatgccatttaaaacgaaaaaaggcagaaaaagtgtggaagacaaaaataggatgaaagaacaagaacagtaattagaacagtaattagaaaanggtaacagatatggcagatattaatccaagtagtaaatacatcaataatcactttaaatatcaatggtataaatacatcaattcaagagccaagattttcaaagtacattagattaaaaagcaagacatgactgtatgttgtctacaagaaaaacaccttaaatgtaaggagaactatacataaaaagtaaatgaatggagaaaaatatatcataataacactaatcaaaagaaagtgggagtagctatattaattccaggtggagcagatatcaacgcaagataaattatcagagataaatagaggcattacataataataaagtagtc

SEQ ID NO: 1450 - DNA, 661 bp, Homo sapiens
  DLG2
  misc_feature [331]..[331]: Chromosome 11, SNP identification no. = rs7943267
  misc_feature [331]..[331]: allele = a, in linkage disequilibrium with rs1454027, respectively
  misc_feature [331]..[331]: n is a, t, c or g
aatcaataattaataaccttcccaaacagaaagaaccaggcccagatgggttcaaaggtgaatcctaacaatcatttcatgaataaattacaccaattatctacaatcacttccagaaaagagaagcacaaaaaatactttctaactcataaatactttctaactcataaaatgttcaagaacaaaagtgaactatactgttaactatggactttgagtgataatgatgtgtcactgtaagttcatcagttgtaacaaatttaccactcagttgtggatgtcaatgcccgtgtgagcaaggcctgtgtgtgtgttaggtggggaggaggtntatgggaaccctttgtactttccatttagttatgctatgaacctaaaactgctcttaaaaaagttattaattaaaaaaattcactagagcagctcaacagtagatttgagttgacaagaaaaaacataagtaaacttggaaatatatcaatagaaatgtttcttttttttaaattatactttaagttttagggtacatgtgcacaatgtgcaggttagttacatatgtatacatgtgccatgttggtgtgctgcacccagtaactcctcatttacatcaggtatatctcctaatgctatccctccccactcccctcaccccacaacaggc

SEQ ID NO: 1451 - DNA, 661 bp, Homo sapiens
  DLG2
  misc_feature [331]..[331]: Chromosome 11, SNP identification no. = rs988322
  misc_feature [331]..[331]: allele = t, in linkage disequilibrium with rs1454027, respectively
  misc_feature [331]..[331]: n is a, t, c or g
gaagggttgttgaattttgtcaaaggcctttcctgcatctatttagattatcaatggaaatgtttctaaggcaagactgctaaaaacaaattcagtcttttgtttatttgggattgtctttgtttcccttttaattttaaaggattgtttttctggatccaaaactcttcgttatcagttcttttcttttagcattttagatatgttattccaattgcctgtggccatgattgtttctaattagaagtcagatgttaaacttatgtagttaccttctatatgacaagttgacttcctcttgctatttctaagattttatctttgcctttcncttttcagcatttgaatactacatttgtagctgtgggtcactttgtgtttatcctgcttaaaatttgttgagcttttcaaatgtgtaaatgaatgtttttcatcaggttttggaaatttgggtcctttatattttcaaataatttttctacccatttcctttgttatttctctgtacttccactatacatatattagtatgcataatgttgtcccacaggtttctgaaaatctattcatttttctttaaaaatgaatgcaaatataaacctaagagagctggagcggctatactgatattagacaacttagaatttaggacaaaaagagt

SEQ ID NO: 1452 - DNA, 661 bp, Homo sapiens
  DLG2
  misc_feature [331]..[331]: Chromosome 11, SNP identification no. = rs1377746
  misc_feature [331]..[331]: allele = t, in linkage disequilibrium with rs1454027, respectively
  misc_feature [331]..[331]: n is a, t, c or g
catcagcaaaatctgctcatatgaacaggattttaggataaaaaaaataaagactgctttacacctcttgtctgttaaaggtaatgatgggtatctggatgagagttagtggtaaagaccttcaggctatgtaaaaccattaatcaatagaacaggaatattccctggctaatttatctgactgctttaaacataggactaaaaaataggaagtgctcagcataagggaaattaccttggcaacgtggcatatattcttttggagagagctgtagaaagactctaaaatgtaaccactactgcctgaaatctttgcagaatgcccacagcnttcagcttttcccaaaatcaaataggatacaattattgctgctggtttccagtcaacattcaaatccatttaaaagcagattcctataaagttgcctctatccaaatatgcaaagtggtcttatgaaaaataacatttatgacccaagatccagttactagttttagcaaccttgagggagccacttagacttcaaaatatagttatacgctttaggtgtatatgtttatatagggatatatgcaaagaaaagcatttgaatactcaatatgcttgtccatctaaaaatctgaattttaggaaactaacaatttggaatttatttttaac

SEQ ID NO: 1453 - DNA, 661 bp, Homo sapiens
  DLG2
  misc_feature [331]..[331]: Chromosome 11, SNP identification no. = rs7941004
  misc_feature [331]..[331]: allele = t, in linkage disequilibrium with rs1454027, respectively
  misc_feature [331]..[331]: n is a, t, c or g
aattgagtgaacaagtaaataaaaagtaagaatataaaagattcaaataatactattgaccaaattggcactatatatattatagaacactcagtatatgcataatacagattctttttaagcacacataaaacactcatcaagtaagactacactgggccataaaacaaatctcaataaatttcaaaggactgaaaacatagactaaattctctgagaataacagaattaaattaaaaaaaaaaacaaaaataaagtaacatatttcttaattatttgtgagtcaaataaaagatcataaagaaaataaaaaatattttgatttgcagcntaataaaagcataatagataacaaatttttttggactcagctaaagtggtgctaaggaaattcattgccttaaatgcttgtaatggaaatcaaaaaagatcaaaaaccaatgatctaagcttctatcttaaaaagctacaaaaatgaagatggtatattcaaagtaactaaaagaaaataatgaaggacagaagtcagtgaaatagaaagcaagcaaacaatagaagatgtcaccaaatacaaggtagtactctgataaaaatcaatgaagttgataaacacctaataaaactgatttttttaaagacagatggcatcaattccaatatc

SEQ ID NO: 1454 - DNA, 661 bp, Homo sapiens
  DLG2
  misc_feature [331]..[331]: Chromosome 11, SNP identification no. = rs10751106
  misc_feature [331]..[331]: allele = a, in linkage disequilibrium with rs1454027, respectively
  misc_feature [331]..[331]: n is a, t, c or g
aaagttttgaaaccagtttacatgtatactggtattaagtaaatagtggatggtagaaagtgggagtctagcttctcacttttggagagggaagtaaccgataagcagaaaaggaaggttagaatagaactggagtatagtcagagacatcaatatgaactcatgtttaaatatagactcatatatgcacccaaattaatagatttaaaaattatagatatatgtgtatacataggataatatacatacatatattacctagatttgtcccttgagagaatctggaaacactagtttaaccacgtgataaaggttaacgtcaccagaaacntcaagtagatattacacatcacctcatgtgatgtattgagaaggacagttgacctctgtgatattctttttaaacactcataaaactagtctgatcattaaagtaaaaacattagataaatctagattaggcacatttcacaggatacttggccagtattctaaagataatcaaggtcgcaagaaataagaaaagcctgaaaaattgtcacaggctggaggacttagagtaacatgacaaatgaatgcaatgcggaatctcggactgaattccagaagagaaagtatacgttaataggaacactggtggaatccaaataaagtttggagt

SEQ ID NO: 1455 - DNA, 661 bp, Homo sapiens
  DLG2
  misc_feature [331]..[331]: Chromosome 11, SNP identification no. = rs7394840
  misc_feature [331]..[331]: allele = a, in linkage disequilibrium with rs1454027, respectively
  misc_feature [331]..[331]: n is a, t, c or g
acatacatatattacctagatttgtcccttgagagaatctggaaacactagtttaaccacgtgataaaggttaacgtcaccagaaacgtcaagtagatattacacatcacctcatgtgatgtattgagaaggacagttgacctctgtgatattctttttaaacactcataaaactagtctgatcattaaagtaaaaacattagataaatctagattaggcacatttcacaggatacttggccagtattctaaagataatcaaggtcgcaagaaataagaaaagcctgaaaaattgtcacaggctggaggacttagagtaacatgacaaatnaatgcaatgcggaatctcggactgaattccagaagagaaagtatacgttaataggaacactggtggaatccaaataaagtttggagtttagttaatagtaatatatcaaagttggtttcttaatgctgacaaatattctatggtaatataatatgttatcaatgtgaaaaactggttcacgggcataaagaaattctctttcctatttttttaacgttcctgtaaatctaagattgttccaaaataaaaaaaaaaatttgttcgtgaagaaatggacaaacacttggaccaacacttagcaagatgggatatatgaataaacaataaaca

SEQ ID NO: 1456 - DNA, 661 bp, Homo sapiens
  DLG2
  misc_feature [331]..[331]: Chromosome 11, SNP identification no. = rs4944472
  misc_feature [331]..[331]: allele = a, in linkage disequilibrium with rs1454027, respectively
  misc_feature [331]..[331]: n is a, t, c or g
agaagacacagcaagtatatactgaattatttcatttttatgagtttaaggaacggcaaaactaagtaatgaagaaagaaatcaggatactggttgattctgggagggcacagactgaaaaaaagaaaagagaactttctagggtgatgtcagtactctatatctcagtttaaagtgttacacaagcgtattcgtttatcaaaactcagcaatctgtacactttaagatctgtgcattttgctgtatataattgtacttcacttaaacatttaggtaaggaaaagaaaagctctgacttgaactcttgaatcaagtttctaaagtatatcnttggatgaaaagaaacaaaacaactgtagaaacagatataacagaaatatatgacatctgttagttctcactggagcataaactactgtaaaaagtgattatagtcatctcagactctcctgattgcaattaagccctctcatattggtgatacaaaagtactttctgtattgctgtattcctctcttatggcattcctattattgcagagatgaatgcaaatgataacccacttcagcctaggtaattgagtattatcctattatacttgtagttcacctccttccctgctcagattgagaccagtgccatattctctataagagaagc

SEQ ID NO: 1457 - DNA, 661 bp, Homo sapiens
  DLG2
  misc_feature [331]..[331]: Chromosome 11, SNP identification no. = rs10751109
  misc_feature [331]..[331]: allele = c, in linkage disequilibrium with rs1454027, respectively
  misc_feature [331]..[331]: n is a, t, c or g
caattgctgcaatcccccttggggcactggaaagagccatgcaaatgaatggcctctaagtttcatttgcttaaaggaaaatctgcctttgttaattttattttaagaagtagtggcagtagatcaaagaatttgtccatttaaacctatttaaaaactaacaaataagcctttgagttttcgtaattgacttgaaaaccagtggctaatgatgcttttctaaggggtcatttgactgaattcaagtacggtacttactttcactttttttgagacaagagtctcgctctgttactcaggctggagtgcggtggtgcaatctcggctcacngcaacctccgcctcccggttcaagcgaatctactgcctcagcctcccgagtagctgggactataggtgcatgccaccacgcctggctaacttttcgtatttttagtagagatggggtttcaccttgttagccaggatggtcttgatcacctgacttcgtgatccgcccacctcagctccctaaagtactgggattacaggcgtgagccgcggcgcccggccttactttcacttttatgagacggggtaggtagatagttcccgtctgaaaatccatgctgccacattgtgtgagccacactgttattattctttactttcaggaggagct

SEQ ID NO: 1458 - DNA, 661 bp, Homo sapiens
  misc_feature [331]..[331]: Chromosome 11, SNP identification no. = rs513935
  misc_feature [331]..[331]: allele = g, in linkage disequilibrium with rs572619, respectively
  misc_feature [331]..[331]: n is a, t, c or g
gactcaataaatgaacagaagacctaataaacacacaaagaagctggtactggtatgtaaacgttagcatgcttaaacctcatcccttcattgtacaatgttcataaacagcggctacccgtttctggaggcctgcttggaccaggcaagagtatgaggtacttcatatggatgatttccatgtcgcctctgcagaactcctgtggcccaggcatttctattcctattttgcaggtcaggaaacagaaaagtgaagcagcttgctcacattcagctggggagtagggagcagtgctaaattctcacccagcggtgttctttccatacctcntgatccctcagaatgacctcttccaggttgaggcacccccacacccagctcctccattccggtccccaccagcctcatactgcagctaaaaggaaacagctaccaagtgaaatgaaaggttggaaagcactaacctgaagttcctgaatatccattttggatatatttcattagtatcttcatcatcatcaacaaacatttagtgagcaccttctgtataccaggtgctgtgctagataataagggtacaaagaactggataccttccctgtcctggaggaactcatagtttagtgggcaggaggagtggttgaggaagtggtctgggtt

SEQ ID NO: 1459 - DNA, 661 bp, Homo sapiens
  misc_feature [331]..[331]: Chromosome 11, SNP identification no. = rs572619
  misc_feature [331]..[331]: allele = a, t
  misc_feature [331]..[331]: n is a, t, c or g
tggaaagtcacaggttcaaagaagtaaaacaaacaagcaaatcaacaacaacaacaaaaacaaaaactgtttaactttgtctcacccagaattttccaaacacatttgagagcaaagccctttttctcaaaacaccttatgtctgggtctgtctactgctctctggaacacagtctgctctcggctctgacagctccacaaagacaactttctcctacctagacatggcctcaaagaccgagctcaaacctgttctcttccatgttgatctcttcagtgtgagctgtggaacaatctcatgcacagccatctaagaaatacaaaattggantcacagcaggttgaggaattggggggcccagggtagatacagtatgggtattcacctaagtgatgctgcctgcttaacactgctcaacacattcatcagagaaacaaccagttcaaagatgtaaggaaatgcaggcaccttttagcccaacagtctacataatgctaaaatctttccacaaagcccgtgatgggctcatccagtgcctgaacatttatgacagggaacttgctgctccctggatatccctcttgtctctagacagttctgaccccatatgtagatataaggctgcctctttagaaaaccccccactagcctggagtacag

SEQ ID NO: 1460 - DNA, 661 bp, Homo sapiens
  misc_feature [331]..[331]: Chromosome 11, SNP identification no. = rs574529
  misc_feature [331]..[331]: allele = t, in linkage disequilibrium with rs572619, respectively
  misc_feature [331]..[331]: n is a, t, c or g
ctacctagacatggcctcaaagaccgagctcaaacctgttctcttccatgttgatctcttcagtgtgagctgtggaacaatctcatgcacagccatctaagaaatacaaaattggaatcacagcaggttgaggaattggggggcccagggtagatacagtatgggtattcacctaagtgatgctgcctgcttaacactgctcaacacattcatcagagaaacaaccagttcaaagatgtaaggaaatgcaggcaccttttagcccaacagtctacataatgctaaaatctttccacaaagcccgtgatgggctcatccagtgcctgaacanttatgacagggaacttgctgctccctggatatccctcttgtctctagacagttctgaccccatatgtagatataaggctgcctctttagaaaaccccccactagcctggagtacagcttgtccaggaccttgccaggtgggctccaaataggctggccatgggaccccattcccagtcacccctaggacttccccatctatgcctacgtttctgaatcaaagcaaccctcttcccagctattagctattgccacattccatggccaaacccctttccttaggccactgttttctaaactttcttgggaccacggatgccactgagttttc

SEQ ID NO: 1461 - DNA, 661 bp, Homo sapiens
  misc_feature [331]..[331]: Chromosome 11, SNP identification no. = rs526151
  misc_feature [331]..[331]: allele = c, in linkage disequilibrium with rs572619, respectively
  misc_feature [331]..[331]: n is a, t, c or g
aaacgttggtctttgttagtgagacgtttgtataaagaaaaatattaagaaccataaaaagagaacaaaaggaacgtttcaaacaaaagaagtggggagaagttagggtaaaacccgtataaacgtctagattctccctctcgatacggaggcaccgaccgaccccatcgtcggtgtcagagtcagttcttctcgattttcgtccatagaccttgtacgtctctccactctcgtcccggacagcccggttcactcctccctaaaaccggtaaaaggtgacaccggcacggaaacactatccaccgtacatcgagactacctttatcagtcnaccgggtttatttacctctgggtgcttccgaagggactaggcaagaaaaatcttgttggtatcgacaaatcgatctcgataagatttttcgagacactgagtacgaaccggaatacaatatcagtaagaacgtgtaccgaacgagagacatgacccgacgttcgagggacttccgaaacgacgacagtatgacgataaaagttgtaccacacaacctagtccccacccacccagggttcaagtccgaggtcaggggtctttccgttgtgaattcttactagagttggtctctaagtttgacacaacgttcggtcgggtagttttaccctt

SEQ ID NO: 1462 - DNA, 661 bp, Homo sapiens
  misc_feature [331]..[331]: Chromosome 11, SNP identification no. = rs571139
  misc_feature [331]..[331]: allele = g, in linkage disequilibrium with rs572619, respectively
  misc_feature [331]..[331]: n is a, t, c or g
ttttagaatagctctagctaaacagctatggttgttctaaaaagaacggatcagggaagccttcgtgggtctccatttatttgggccacctgactatttccatcagagctacatgccacctatcacaaaggcacggccacagtggaaaatggccaaaatccctcctcacttggcccgacaggccctgctctcacctctctgcatgttccagatacctgcttttagctcttcttgactgagactgtggctgctaccccagccagccacggaggcatagctctccctcttagatctgcaaatatgcccaaaatgggattgaagaggggtgaanaaaacaaactttgcaaggaaaacaagagaaaaataccaagaattataaaaagaaatatgtttgcagagtgattgtttctggttgcaaactgagcacttagcaaaatattgacttgctgggcacagcctttgagggccccaggcggtggtctcttgccatttcaagattttctttgctgaatacttaagagatatttgaatttctctccaagcagataaaggctggccctctcccaggtgccatgggatcctcagtgccttcttgaatctgtctggtctcccatttgggtccctagttacctccattagactgaagctgctgctctgacac

SEQ ID NO: 1463 - DNA, 661 bp, Homo sapiens
  misc_feature [331]..[331]: Chromosome 11, SNP identification no. = rs488435
  misc_feature [331]..[331]: allele = c, in linkage disequilibrium with rs572619, respectively
  misc_feature [331]..[331]: n is a, t, c or g
aactcaagaccctcctgacttgaacctggaatagtcctctcacctgcctgcctccctggctatgcatgcttggtttgctgaccactaaatgtcagttaaaacttattctcttctcagataaacttgctctgcaccccttgtgcatccacatctcactcatctacttccaggcagtcttgagagctgacaccctctttccctggctgggtcacactgtttccttcccaggatcagaaatagacacgacctccatttttacctgtaaatcccattcttccttttacactcaccctctggtctcctggatggagagtggagtcatcctgtttanagcaacaagttggcaattgcagcaatgccctaagcatcctccgtgcctcaggcctcccaggccctcatctgtattccacagttcagcagggaaagagctttccatagtgcatgtcttgtgcaacttccccagcctcacattcctggcctcccattgttctcacagaatacctatgtctgattcacagtcaacagcaccctgtgtgaggcattccccacctgccttcccagtctcaatcctgggcactccccgtcattcaccttccctccagccattctagttagagggtcccaaatgcaccctgcttttcaccggcccttctgcttcctg

SEQ ID NO: 1464 - DNA, 661 bp, Homo sapiens
  misc_feature [331]..[331]: Chromosome 11, SNP identification no. = rs491111
  misc_feature [331]..[331]: allele = g, in linkage disequilibrium with rs572619, respectively
  misc_feature [331]..[331]: n is a, t, c or g
tttttacctgtaaatcccattcttccttttacactcaccctctggtctcctggatggagagtggagtcatcctgtttacagcaacaagttggcaattgcagcaatgccctaagcatcctccgtgcctcaggcctcccaggccctcatctgtattccacagttcagcagggaaagagctttccatagtgcatgtcttgtgcaacttccccagcctcacattcctggcctcccattgttctcacagaatacctatgtctgattcacagtcaacagcaccctgtgtgaggcattccccacctgccttcccagtctcaatcctgggcactccccntcattcaccttccctccagccattctagttagagggtcccaaatgcaccctgcttttcaccggcccttctgcttcctgcctgccctactccatacactgaaggaatgtttactcaacctccaccaggaaaccctctttgacctccctcaacagagacagccacatcattctctgtggatcccacagtgctgtatttggacctgtgttacaagataatattatttctgtaattatggatgttctgtctccccaagacatcaaactgtggccaaaagcccagactcagagtccaacagagcaaagatcaaattccagctccatcgttttcta

SEQ ID NO: 1465 - DNA, 661 bp, Homo sapiens
  misc_feature [331]..[331]: Chromosome 11, SNP identification no. = rs567559
  misc_feature [331]..[331]: allele = g, in linkage disequilibrium with rs572619, respectively
  misc_feature [331]..[331]: n is a, t, c or g
aaagagagcaggtttcctgttcactaaagaaggggaggaaggcccctctgcggcccaggcagccatagctctgctccaacccacatgacccctggcatctgcaatgatttgcagagagagaaaagggaaagagagtgagccccagacagggagagatagagagagcatttgactcattagcttcatattaaattctgacgtttgaacctgacggaatccgagtagggctggagtaatgaattaatcccagggaagaagacaggtctacagctcctcagctattagcagcccactgtgcaggggagccctgctgagctgacatgtgtcacanagtttgttccccaccacccggctccttgtggaacctccctggtctggcccagtcaacctcaggaagattagcacatgatagggattcaacatgtgtttgcccattgaggcacgaattgaggagtaggtcactccccctgcagtttgatgggatgagaccaagcctcctgtgagtgactgccccagctagcagtctccacatctcctaggggtcatttggtctagaccctcaccttcggacccctttccagggtcacagattggagtatctcctagcaatggatcataaaggaaaatgatgaccacagtggttatcagcttccccagattt

SEQ ID NO: 1466 - DNA, 661 bp, Homo sapiens
  misc_feature [331]..[331]: Chromosome 11, SNP identification no. = rs541874
  misc_feature [331]..[331]: allele = c, in linkage disequilibrium with rs572619, respectively
  misc_feature [331]..[331]: n is a, t, c or g
cccagctagcagtctccacatctcctaggggtcatttggtctagaccctcaccttcggacccctttccagggtcacagattggagtatctcctagcaatggatcataaaggaaaatgatgaccacagtggttatcagcttccccagatttgtattcattcattcattcattcattcattgtctgtctgacacacacacacacacacacacacacacacacacacacacacactccccaaatctatcactctccccttcagtcttcctggctacccgcatttttattgatggcagttcaggggcagtcacaggatgatgctggcacaaatcntcaaaagagaaagacaagagagagggagccacagaaaggcatctccacatccccccagctctcttctccaggctgggctgtctctaaccccaggccacagaattcatcgctcactctgattcagtgggacagttattttatattattaaaataagagattatcatcaccaccaatctccatctcctttccaatctcatctgaaaagcaggcattgcctcctgctcccggacccctaattctctctgcctcggctgttaaatcatttaacctggtaaagtgtcaggagatgcattttacatgagagacacgaggcgggataaatctgggct

SEQ ID NO: 1467 - DNA, 661 bp, Homo sapiens
  misc_feature [331]..[331]: Chromosome 11, SNP identification no. = rs11215905
  misc_feature [331]..[331]: allele = t, in linkage disequilibrium with rs572619, respectively
  misc_feature [331]..[331]: n is a, t, c or g
cctgagaggcatggattcggttagtttagctctggttcctgacagagtgaaagggaggcccatcctggaagatgccccgtaggccagacgagaggactagctgattcagactcagcatggccctgcccagccctgggacaggaccacctttctccctagagatgaggaacatgctggtgaattcctctcactccctttttacttccaaggaactttagataaatctactaaaagtaaaaggaaaaaagtctcccctcatgatattggggatctgtctgcctctccatgcttcaaactgtccttctgcctctctgctccctcctcctctatncccctcatggctgccagcagtcttctctacctctcactatgaccatgtgctctctagtccccaactagagacctcctctatccagaagctgcctcacttcccccttgtgtctccaaaccctcttccccatacttgtccaactgcccattctctctccccaggtcttctcaactcagctccctacacttagaatgtaccaagcacttcaccagtgtacgctccaatctttataaccctctgatatggtttagctgtgtccccacccaaatatcgccttgaattgtagctcccataatccccacatgtcaagggtgagaccagatagagata

SEQ ID NO: 1468 - DNA, 661 bp, Homo sapiens
  CD69
  misc_feature [331]..[331]: Chromosome 12, SNP identification no. = rs3176789
  misc_feature [331]..[331]: allele = t, in linkage disequilibrium with rs724667, respectively
  misc_feature [331]..[331]: n is a, t, c or g
tttctagaaagagaaacgaaatcaaatatagtagagtcacaaatctaaattaatcttttgaaagacgagatcgggtcaataagaggtagtaaaaaaagtataggtagacatgtaagaggtccttcacaacagagagaaatactttttaagacaaaaggtgtattcgttaatgtaacaaacggaaggaaacgtaagtcacagacgaaagtcacatggaataggacacaagagtactgtcgtaggagatcaacgacctttacccgttcaaacggtagaaactctcttatcgatatagtcgtctacttttaaatgtcacaggtaaacattaaangattttttttttcagtgttttcttaagggcttttacgttagaggacgaaaccataagaaatatcctgagaaaaggagataaagtaggaagataaattggaaaggttagagaccgaagtttctgatacattgaatcttaaacaagaaggaaaggaaacagagagtcgttttatattagtagaatctttaaaaggagagaagataaacagataagataggtgtatagatcgaataaaggacaatgaccctaaaacggataacaaaaagatatggaatgaagacattttaaacaactcaaaaagataaatagggagaaagaggaatcaattac

SEQ ID NO: 1469 - DNA, 661 bp, Homo sapiens
  CD69
  misc_feature [331]..[331]: Chromosome 12, SNP identification no. = rs2071647
  misc_feature [331]..[331]: allele = a, in linkage disequilibrium with rs724667, respectively
  misc_feature [331]..[331]: n is a, t, c or g
tttattattagtatggagttttctgacttcagagtctccatagacttctcttattggatctcgtgtccccctcttaacttcctcgacaatgactccactgtattttcgtcagatttactgtcattttacactgttcttttaatcgtcctttgtttactttgtctattaaattctatttgttaaaatctcgtatcgttccttcaaggtctggtgttcgaaagacaaaggacgtaagaatgaagaatgatgcactatgtagatcagtggtcccttcttcgcttactgtgtgaaggtttttggttaagcatcgaaagatttattttgggaaagntcgacctctctctaggtactcgtatctctagaattttaagtacaagtcgttatttaggaccccggggtctgtcacagtccacgtatcccccacaagtcatttatagtcaatttacatacgtatttagctatttgccctaaggaccttttatgatgtgagaggaagaggtttaatagaagtagagtttctgtccttggagattgaaaattaagaaatgaatctaatacgacagaggatttgacaaatacaaaagatctttaaattccgtcctacagagtctcagacccttttagggtgaaaggaggacgatgtggaatgtcaacactcttt

SEQ ID NO: 1470 - DNA, 661 bp, Homo sapiens
  misc_feature [331]..[331]: Chromosome 12, SNP identification no. = rs3136559
  misc_feature [331]..[331]: allele = t, in linkage disequilibrium with rs724667, respectively
  misc_feature [331]..[331]: n is a, t, c or g
aaagaaaccgaattgttcataactaatcatggcacccgtatatcaaataacatggattctcctgtaacagtgttcactttatcgtatgagaattattagtgactttatcgcaccacaattattaatgtacaacaattattaattgtcgtacacagtcgatcctgtcacggttcgttggtaataagtgacactcaaatttaactaacgaaagagtttaattttctctaaagagtgtgaattctttttatctttcttaataccttccctcccttctatttacttctttttcaattaaaaagttgttcaagtccgagaacgtcttctggaactngtcgtaccccgggtcacctataggtcctccggtgactgttggtacacgaaccatgcaaccgatgaaaaaagaacgtcaccgacggaggagggtgcgtgggttcatgactaaagttgttttatgaacccgataggggtattttttttcgtctcttcccggtcctcgtcaccgaatacggacattagggtcgtgaaaccctccgcctccgttctcctagtagactccagtcctcaagctctggtcggaccggttgtatcactttgaggcagagatgatttttttttttttttttatgtttttaatcggcccgcaccaccacccacggacatt

SEQ ID NO: 1471 - DNA, 661 bp, Homo sapiens
  misc_feature [331]..[331]: Chromosome 12, SNP identification no. = rs3176776
  misc_feature [331]..[331]: allele = c, in linkage disequilibrium with rs724667, respectively
  misc_feature [331]..[331]: n is a, t, c or g
cacaaaaaaaaaattctcttgatttgggtagtcccgattggtgttattcaaacgaaggtacaaaactaattttttttcccccatgacttcttgagagactgggggtttagagagggtgtgacgtagaactgggagatgtgaaaggaaacaaaaagagaccttaaagtgcacatctctatacaaagaaaccgaattgttcataactaatcatggcacccgtatatcaaataacatggattctcctgtaacagtgttcactttatcgtatgagaattattagtgactttatcgcaccacaattattaatgtacaacaattattaattgtcgtncacagtcgatcctgtcacggttcgttggtaataagtgacactcaaatttaactaacgaaagagtttaattttctctaaagagtgtgaattctttttatctttcttaataccttccctcccttctatttacttctttttcaattaaaaagttgttcaagtccgagaacgtcttctggaactcgtcgtaccccgggtcacctataggtcctccggtgactgttggtacacgaaccatgcaaccgatgaaaaaagaacgtcaccgacggaggagggtgcgtgggttcatgactaaagttgttttatgaacccgataggggtattttttttcgt

SEQ ID NO: 1472 - DNA, 661 bp, Homo sapiens
  misc_feature [331]..[331]: Chromosome 12, SNP identification no. = rs3176775
  misc_feature [331]..[331]: allele = a, in linkage disequilibrium with rs724667, respectively
  misc_feature [331]..[331]: n is a, t, c or g
aaaaccacaggactttctgaaaacggttggaacaggggcgtgattaaagagattcggagccgatatgataaaagagtcgatgtgctactttacacttactattaaagacgggatttttatagtgaattaaaaaattgtatagtaaatactttcttctgtgtattttacagagggattttacctttcaatgtataataacggtagacacaaaatatttctccaactttccccaaacgaacgtgttccaaacaaagaaatacacacaaaaaaaaaattctcttgatttgggtagtcccgattggtgttattcaaacgaaggtacaaaactaantttttttcccccatgacttcttgagagactgggggtttagagagggtgtgacgtagaactgggagatgtgaaaggaaacaaaaagagaccttaaagtgcacatctctatacaaagaaaccgaattgttcataactaatcatggcacccgtatatcaaataacatggattctcctgtaacagtgttcactttatcgtatgagaattattagtgactttatcgcaccacaattattaatgtacaacaattattaattgtcgtacacagtcgatcctgtcacggttcgttggtaataagtgacactcaaatttaactaacgaaagagtttaat

SEQ ID NO: 1473 - DNA, 661 bp, Homo sapiens
  misc_feature [331]..[331]: Chromosome 12, SNP identification no. = rs3176773
  misc_feature [331]..[331]: allele = c, in linkage disequilibrium with rs724667, respectively
  misc_feature [331]..[331]: n is a, t, c or g
taagggaaaattctattttcagggtcttacagtaggtggacctccgtaaaggatccatacaatccacgtgtgtctaggtgtccttcaccctattcgtcaagacaagtttaagtaatacgtagatagtttgttctaggttcatgttaacctatgtaaaatactatcgtatcatcgggtctggggccggatggaattttaagatataccatgtaaacgataaaagtgtggtaatagaaactctcatcagaggtttttacaacatatacctattcagaccttaattaaatccatttcatgagtctgtaccaattcgcaatatagagtagaaatnatatcgagaagaaaataagagaatacataaaatgaaagtctttgtcagtccaaaaagtctcaggttcgaacacacatgtgttcgtgatagaaaatggaagtgacagagttcagtttttcttcttttacggtcgagtgtgaaaggttcgagtaaaaaacacaaagtctacaaggtaacttctcctttcaatctttcaagtttctgaacttctcctgtcttccaacctttcacaaattttgacctttagggggcaaatgagtaccaatggaagtaactgggaaatgccatttgttaagtttttgtgtttccgtggacgtccaatttttattt

SEQ ID NO: 1474 - DNA, 661 bp, Homo sapiens
  misc_feature [331]..[331]: Chromosome 12, SNP identification no. = rs12422685
  misc_feature [331]..[331]: allele = a, in linkage disequilibrium with rs724667, respectively
  misc_feature [331]..[331]: n is a, t, c or g
tgggattacaggcgtgagccactgcactaggcccctttaagctttcatccacttctctcaataccaacatcttacaaaactaaggtgcaatatcacaaccaggatattgacgctgacacagttaagatacagaataaatccatcaccacatgaatctttctgttgtcctttagagttaaacccatttcccatttccctccacaagccctggtttattaagaaattgcccagctctgttccagagtggctgttcctttttacagtgccatcaacaatacacgagtgattcagtttctccgcatctttgccagcatttgatgtcgccactctntttttaaaatttcagccattctgataggtgtgcagtgatatctccctgtggttttcatttgcatttccctaatggctaatgatgttgaatatctttttgtgtgcttagttgctgcttgtatgtcctctagtgaaatatctgtatcttttgcctgttctaattgatttgtttgtggttttactgctgtttttgaaacaatcaatatgaaatttgaacccatattttcaactgttgtttcacatacagcttgtgcctgtggatgtcatcgttgccatatttctatataagattctgcccccacactaaaataaaataaactagaattgtatt

SEQ ID NO: 1475 - DNA, 661 bp, Homo sapiens
  misc_feature [331]..[331]: Chromosome 12, SNP identification no. = rs724668
  misc_feature [331]..[331]: allele = t, in linkage disequilibrium with rs724667, respectively
  misc_feature [331]..[331]: n is a, t, c or g
tatacaaattattgtatcggagttttagataatttcttaaaaactgtctaaaattacttctttatctgttaagatattggtttcccataaaattgtaaggagatacttattaaatatcttattggtctggttttatagtcatttctatatcttccaaacttgttgtggtagttagtagaaccagattaaatacaaatgtctcgttatgtgggttgttgaagtctgacggggaaaaaaagacttacacgtaccgtgtacgtaaactctatttggtacatgaatcgatatttatttggagtcacacaagagactggttttaccttttttgtgnataaacgtttaattcgttcagaaaagatctattacgttcacactttaatattcctttaatcttttataagagtgaacttgttattatttttgcattgttggttttaatccccttctccaaatattgtcaaaacctcacttacaagaccgaaatttagtcggtaggtatgtaaaaaaaacacacatatcatttctcgccctctcatttataaaatccaaaacgtcttgtattttggaaatagtgttttgaggaaaaactagaagatcggggttttgtcgttatctgttatactttcgttcacccgtaccgacataaggttattttaaaata

SEQ ID NO: 1476 - DNA, 661 bp, Homo sapiens
  misc_feature [331]..[331]: Chromosome 12, SNP identification no. = rs724667
  misc_feature [331]..[331]: allele = g, a
  misc_feature [331]..[331]: n is a, t, c or g
cagtctttgtaaaatttatacttatacaaattattgtatcggagttttagataatttcttaaaaactgtctaaaattacttctttatctgttaagatattggtttcccataaaattgtaaggagatacttattaaatatcttattggtctggttttatagtcatttctatatcttccaaacttgttgtggtagttagtagaaccagattaaatacaaatgtctcgttatgtgggttgttgaagtctgacggggaaaaaaagacttacacgtaccgtgtacgtaaactctatttggtacatgaatcgatatttatttggagtcacacaaganactggttttaccttttttgtgaataaacgtttaattcgttcagaaaagatctattacgttcacactttaatattcctttaatcttttataagagtgaacttgttattatttttgcattgttggttttaatccccttctccaaatattgtcaaaacctcacttacaagaccgaaatttagtcggtaggtatgtaaaaaaaacacacatatcatttctcgccctctcatttataaaatccaaaacgtcttgtattttggaaatagtgttttgaggaaaaactagaagatcggggttttgtcgttatctgttatactttcgttcacccgtacc

SEQ ID NO: 1477 - DNA, 661 bp, Homo sapiens
  misc_feature [331]..[331]: Chromosome 12, SNP identification no. = rs724666
  misc_feature [331]..[331]: allele = c, in linkage disequilibrium with rs724667, respectively
  misc_feature [331]..[331]: n is a, t, c or g
aatggtttaggtctaaatgtccaattaaagcagatctttgtgggaacgtctgtgtgggtgtttattacaaaccggtttatagacccgtgacgtactacgtcagtacaactgggtattctaattggtagtgttggtggtaggtgtcttcaattctctcgagatcacactcaaattacccagtaacccgcgattttgtttttatagttatataaaacttatatataagtcttttataacgtcttagattttcccgttacgtagtcagtctttgtaaaatttatacttatacaaattattgtatcggagttttagataatttcttaaaaactgnctaaaattacttctttatctgttaagatattggtttcccataaaattgtaaggagatacttattaaatatcttattggtctggttttatagtcatttctatatcttccaaacttgttgtggtagttagtagaaccagattaaatacaaatgtctcgttatgtgggttgttgaagtctgacggggaaaaaaagacttacacgtaccgtgtacgtaaactctatttggtacatgaatcgatatttatttggagtcacacaagagactggttttaccttttttgtgaataaacgtttaattcgttcagaaaagatctattacgttcacacttt

SEQ ID NO: 1478 - DNA, 661 bp, Homo sapiens
  misc_feature [331]..[331]: Chromosome 12, SNP identification no. = rs10772132
  misc_feature [331]..[331]: allele = t, in linkage disequilibrium with rs724667, respectively
  misc_feature [331]..[331]: n is a, t, c or g
tacattctaaggcttgtacactcaacctcttttccttccttcttttcctcacatggtataatatgaaagctctaccatccttttctggagtcttctcaatttttgtcaactgtattttctctaacaaatatgttgcatgtctaattctttattgaagtctgcttctcaggggacccaaagtaacacactttgtctggtacgtatagttagaaaaattgtagagtttttatcggaaattgatcactcataaccaaacatcttgcagtatgcctggaggcagagccgtaatatcactgggaaactcatcttcatgctgataatttctccaagntgtgattattttccacatacaactattctaattgctcttataggtctttagattacttgggttcttttttttttttgtattttgtctggatgacatatttctaatcagtaattgtgtgggtccgtgtgtgtgtttgttggggcaaaggggaatataggtaacactaccacatggaggcagaaatttactcatcgtttcttaatgttcaacttgttacttcttagacactaagattcctctttaggctggttccatatcttttcactcatcatctttaatatctttacttttctttgcatttgaataataagaatgacttcagctgtaaaa

SEQ ID NO: 1479 - DNA, 661 bp, Homo sapiens
  misc_feature [331]..[331]: Chromosome 12, SNP identification no. = rs1029992
  misc_feature [331]..[331]: allele = g, in linkage disequilibrium with rs724667, respectively
  misc_feature [331]..[331]: n is a, t, c or g
aagaaagtggaaaggatgaccttttacctctgataaatctacgagtagtaaaaagtacaccaggaccacaaagttctcgtcatctaaggtaggacattgagtcttctgcttaggattgaccaggtctattggtaccactatagttaagatacgatcgttgacccaatattttccggtcattccgatcgtaaacatcgattacaaccgactcgtggttgaaagttggtatataatgtaattcacaaaaacttcacactcgagtaattcaaaaacgttgttaaaatacactttcatgtgtacaacagagtaaaatgctaacttttttaacttnttaattctcttaaacttaaactaataagatatgaactgtcgggaactatttctccttaacctatctaagagaccttgttcgaaagaacctctgcacgacatagatccgatcctgtaactctaacgatttccaagaccaagtacacacttcttggacttccttttatgagattgttaatcttctactcaatatatgtcaataaatacagaaggaatgaccaacaagaacacagacggacactaagaatcttgtctgtgtcggtaaaacattagcaatcctctttactacggttgattattcttatcgttttatctttctattgaggaccca

SEQ ID NO: 1480 - DNA, 661 bp, Homo sapiens
  misc_feature [331]..[331]: Chromosome 12, SNP identification no. = rs1029991
  misc_feature [331]..[331]: allele = a, in linkage disequilibrium with rs724667, respectively
  misc_feature [331]..[331]: n is a, t, c or g
accaagataaaacaaaggaaaaatagactaagacgataaggggtgggtgaagagatttgaaatgaagtatcttttggacagataccacaaacctgttatcgtgaaaaaaaaaaaaaaaaaaaaaattcaaagttcaatagactacaccaaaattttaaaggacaatcctctaattctgtttacactcaatccctgtatttcaaggtctcgaacttatacttctagccattgtttctaaagaaaaaccgtttataaaacggtattaacaacgtctgacacaactaaagtatcggtcgtacgataataaagaaagtggaaaggatgacctttnacctctgataaatctacgagtagtaaaaagtacaccaggaccacaaagttctcgtcatctaaggtaggacattgagtcttctgcttaggattgaccaggtctattggtaccactatagttaagatacgatcgttgacccaatattttccggtcattccgatcgtaaacatcgattacaaccgactcgtggttgaaagttggtatataatgtaattcacaaaaacttcacactcgagtaattcaaaaacgttgttaaaatacactttcatgtgtacaacagagtaaaatgctaacttttttaacttattaattctcttaaacttaaactaa

SEQ ID NO: 1481 - DNA, 661 bp, Homo sapiens
  misc_feature [331]..[331]: Chromosome 12, SNP identification no. = rs1029990
  misc_feature [331]..[331]: allele = g, in linkage disequilibrium with rs724667, respectively
  misc_feature [331]..[331]: n is a, t, c or g
tctcttctgacttaatgagtaacacacaggagaaacgatctgccgtgtgagggatttttttaccgatattaacaaaacgagttatgacctagaaatcgtgtatgaataaagtcacaaaccttgttgcattcacacgtaatttataaccaacttataacttacttaaccacgttaagtcactttacgttaatgaatagattaaaatacgtaatcatcgtcagttaaaagtttagtgtaaggaaatactaaagatcggacccagagatgttgaacgttggtcttatatatagagaatccggaagaggtaaacttcgacaacgatgactacacncgaccaagataaaacaaaggaaaaatagactaagacgataaggggtgggtgaagagatttgaaatgaagtatcttttggacagataccacaaacctgttatcgtgaaaaaaaaaaaaaaaaaaaaaattcaaagttcaatagactacaccaaaattttaaaggacaatcctctaattctgtttacactcaatccctgtatttcaaggtctcgaacttatacttctagccattgtttctaaagaaaaaccgtttataaaacggtattaacaacgtctgacacaactaaagtatcggtcgtacgataataaagaaagtggaaaggatgacct

SEQ ID NO: 1482 - DNA, 661 bp, Homo sapiens
  misc_feature [331]..[331]: Chromosome 12, SNP identification no. = rs10844749
  misc_feature [331]..[331]: allele = a, in linkage disequilibrium with rs724667, respectively
  misc_feature [331]..[331]: n is a, t, c or g
gctattgtccaaacaccatagacaggttttctatgaagtaaagtttagagaagtgggtggggaatagcagaatcagataaaaaggaaacaaaatagaaccagcacacatcagtagcaacagcttcaaatggagaaggcctaagagatatatattctggttgcaagttgtagagacccaggctagaaatcataaaggaatgtgatttgaaaattgactgctactaatgcataaaattagataagtaattgcatttcactgaattgcaccaattcattcaatattcaaccaatatttaatgcacacttacgttgttccaaacactgaaataantatgtgctaaagatccagtattgagcaaaacaattatagccatttttttagggagtgtgccgtctagcaaagaggacacacaatgagtaattcagtcttctctcctttttttcttggtcattctagtcaaagttttatccattttgttaatctttaaaagtagtaacttctgatatcactgattctttttattgcttttctattctgtattttgcttattttctcttaaattttcattactttctttcctcttgcttttggtttagtttgctcttcttttttcagttttcttaaggtggaagtttagattattgattttgttactggtgg

SEQ ID NO: 1483 - DNA, 661 bp, Homo sapiens
  misc_feature [331]..[331]: Chromosome 12, SNP identification no. = rs1540356
  misc_feature [331]..[331]: allele = a, in linkage disequilibrium with rs724667, respectively
  misc_feature [331]..[331]: n is a, t, c or g
catgaaatgaagaaaagtaaggacaggattttgaaaaattatttgaaagtgaggacgagattttaaacaggaccagagaggaagacggaatacggggaaccagtttaagaaagaagactcctccgtttttgactccaacgacgtttggacatctctaagtggtggtcattgttttagttattagatttgaaggtggaattcttttgacttttttcttctcgtttgatttggttttcgttctcctttctttcattacttttaaattctcttttattcgttttatgtcttatcttttcgttatttttcttagtcactatagtcttcaatgatnaaaatttctaattgttttacctattttgaaactgatcttactggttctttttttcctctcttctgacttaatgagtaacacacaggagaaacgatctgccgtgtgagggatttttttaccgatattaacaaaacgagttatgacctagaaatcgtgtatgaataaagtcacaaaccttgttgcattcacacgtaatttataaccaacttataacttacttaaccacgttaagtcactttacgttaatgaatagattaaaatacgtaatcatcgtcagttaaaagtttagtgtaaggaaatactaaagatcggacccagagatgttgaacg

SEQ ID NO: 1484 - DNA, 661 bp, Homo sapiens
  misc_feature [331]..[331]: Chromosome 12, SNP identification no. = rs12582052
  misc_feature [331]..[331]: allele = t, in linkage disequilibrium with rs724667, respectively
  misc_feature [331]..[331]: n is a, t, c or g
tgtcccttctcccctgattcttcccttgggctgggctgtccgcatgtgtactggcctgctagcacttgggaggggagcatacgcagtgtgtttactggagttgtatgcatgcaccttgaggcattcttcctttaccagttgaatgcccctagaagcccatataccagttaagctctgccattttgccacttagtgtgcatgtttgagcccactcgcccaacacctgagatcttattgggacgctaatcagcagtttcaggtttttctatctattgggagactgcctttccctagggccaactgcaaccaattattattttggaacgagagngtaacaactagctgaccatcacctgacattcctggtgggtggaggacctctcccacccttctcatgtctgcttgatcacctaccgtaacaatctgagatctttctttaaatgtaggtgtttattgcagtatgttttcttctgagcactgttttcactgcatcctataaattttgatatgttttgtttattgtcatacaatccaaagtctaatttcccaggtgattccttctgtgacccattggttatttagaagtttgctgtttaattttcacatatatatgaatttgccaaatttgtttctcttactgatttctattttcattttcatt

SEQ ID NO: 1485 - DNA, 661 bp, Homo sapiens
  misc_feature [331]..[331]: Chromosome 12, SNP identification no. = rs1861090
  misc_feature [331]..[331]: allele = g, in linkage disequilibrium with rs724667, respectively
  misc_feature [331]..[331]: n is a, t, c or g
agtgatgttgggttctcggcagtgtgtttaggaaaaaagagtaatttgttttggaaggtctcctctgtcactaaaaatggtagacgggtggtctcacgtgtctcaggtcctcggaccacccattctttgaaaatggggaaacggttgtctagtccaatgacccaagagaagagtcgtcgaagatcttcgcttcttgtcgaaactcaggaaaaatgacgtgatagtgcccccggtaccggtaaccgggtgatttcaaaacgaatttttagtcaccgtactccgtgtaattaattatcctcttttccgtatgtttaaataaattagacatatntttctctgaagtcttacttctgccagggttgttattctaatttttcggtgtcatttcttacgtcttagtcccgcaccggttttggtccaatacaacgattcagtctaaatcactgttgtgtccaatactccctttctttccgtcctcgaaccgatcgttgtctctgaaacaatgcatctactttaagagtccatcagtttaaaaaatagaaagaattggttggtccaaaaaatctccacctttaaactgaaagacgtcgacaccctcaaagtcagttgtaatctctaccggtcctcaaccagtttagattgtcttctacttagttggtgg

SEQ ID NO: 1486 - DNA, 661 bp, Homo sapiens
  DDX11
  misc_feature [331]..[331]: Chromosome 12, SNP identification no. = rs11051239
  misc_feature [331]..[331]: allele = g, in linkage disequilibrium with rs4931434, respectively
  misc_feature [331]..[331]: n is a, t, c or g
tgggtctctcatggtgtgcttctccctttgtctgtgttcccatttgcatggagggctatgggttgtgtatggtctgacatttcccatttggtttcattgatttatgacttgttttctgtcggaagtaggtattttctttgtattttctttttttctcccttcactcttgccttagaggagtagagagagggtattctggtcagccttcctttttccctttggggatgtgtgtgacacactccctcccctcccaccaacaacccaccctccccaagtggggaccctttgccacgggagatggtcacccatgtccaaagattggccaaccccncaaaagcggttgattagaggctggatatgactcgtggaaggagctgcctttggggcattcccttgaacttctggagctgtgggtgacttgggaatccctgggtccctcgatagatgcctgacatgggacattgctgtcctgcctcggctttgtgcattgggagccactccctttccctcagcctctcaggccctggcgtgccttgatgttagagaatgctgtgggatgttttggttctctctttgaagcgcctttctttctctctgctagatttattactgtagtcggacacactcccagctggcccagtttgtgcatgaggtgaagaag

SEQ ID NO: 1487 - DNA, 661 bp, Homo sapiens
  DDX11
  misc_feature [331]..[331]: Chromosome 12, SNP identification no. = rs1808348
  misc_feature [331]..[331]: allele = g, in linkage disequilibrium with rs4931434, respectively
  misc_feature [331]..[331]: n is a, t, c or g
cacaagctgtttttcgaatgtctctacacagtccaggcaggaaatagaagcactcacatcaggagctcagtgtcaggcaggcaaggctcctgcaggggagccccgccctgctcaggtggcctcatctcccctcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccaggtgtgtgggcctcccctccccgggccagggcctgctgtgangtaaagggacttggatggttcctccagacacctgggccaagagttcctccggaggtggggcttgatagagggtgcacgagtcaaggcggtgacctcatcggaggctgaccatggctttccagtgcatcgggggaccccgctatgacagagtgcctcatttccctgcacctcatctgcccccatgctcctgagtccctccagccctggatgccagcagccagttctgtaagccagggagatggcatgtgtgaggcagaagtcccctcaggattggattttgtcattactgaagttgtctggaggggactgaattgaggaatgctcaagatc

SEQ ID NO: 1488 - DNA, 661 bp, Homo sapiens
  DDX11
  misc_feature [331]..[331]: Chromosome 12, SNP identification no. = rs2075322
  misc_feature [331]..[331]: allele = c, g
  misc_feature [331]..[331]: n is a, t, c or g
tacctcgttcctctccactgctctctctcatcccacccagctctttggattcactgaacggtacggagcagtgttctcatcccgggagcagcccaaactggctgggtttcagcaattcctgcagagcctgcagcccaggacgactgaaggtgaggcaggagggtgggcaggcagagccggctgcacgcatgggcaaggacttctgttcctcatgtgtggacctgaccagagggaggcctcctccccgttctgctctgtgcagctcttgcagcccctgcagacgagagtcaggccagcaccctgcgaccagcttctccactgatgcacatcnaaggcttcctggcagctctcactacggccaaccaggacggcagggtcatcctgagccgccaaggtaatcaggtggttcttggccaggttcagttcccaggaaggagccaagctgagcccgggagccgcagcgtgaaaggattctttccttccatcctgggaacttcctgggttaggaggaagcagtgcagtgggcactggcctgctgtgacctgggcaagcagtggaggtggatgggaggagatcgaagggctgggatgggggtcccgtgaccagggtaagcagtggaggtggacgggaggagatcgaggagctgggatgggggtcctct

SEQ ID NO: 1489 - DNA, 661 bp, Homo sapiens
  DDX11
  misc_feature [331]..[331]: Chromosome 12, SNP identification no. = rs4931432
  misc_feature [331]..[331]: allele = t, in linkage disequilibrium with rs4931434, respectively
  misc_feature [331]..[331]: n is a, t, c or g
taaagtcacgtggaaccaggcttctctccgtgtgcttctgttgtcagtttcatagataactaggctgtttttgtttcattttcttttcaattttagaatttgcttttttcttttctgacttgtagtttttaaatatgtaaatatttgtatggctcaaaagtcaaagcaatataaaaagatctattcaggaaagcctcactctcatccctttccagcccattccccacccccatagggaatccgttttactagcttatcctttcagtctttctttttcccctaaataagcaaaaacgtgtcttcatttttccctttcctgttttatttacanagaaggcatcttagtcagttgtctgaccatcgctcctctagtgggctgcgtggttctctgttggacagatgtagggagcttatccaaccagtaccctctggataggcaggcgcatgattacagggaaaggtccgggggcacatgctgtttggtatttgtgggctgtatcttctcactggactcctaaatatgggattcctgggttaaaaagtataaatatgtttaatttgttaactactgtgaaatttcatgagaattgtaccattctgtatcccaccagtactgtctaggaatgcctgtttctccagagtggttacttttggatttttg

SEQ ID NO: 1490 - DNA, 661 bp, Homo sapiens
  DDX11
  misc_feature [331]..[331]: Chromosome 12, SNP identification no. = rs11219
  misc_feature [331]..[331]: allele = c, in linkage disequilibrium with rs4931434, respectively
  misc_feature [331]..[331]: n is a, t, c or g
gccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctanaggtccttaaataaaagtgtgctgttggtttctgctgagttttttattgatatgtgctgctgttttctctggaagcctctttagggaatcgaggagcgcactggtgcaggggctgggtggagccatcctccgatggagcacaggcagacggaagcccccaccccagctgcgtggcctcaagccagcctcccgctccccgaaggtggtctccacacagacctgggacagtttcatccccgccccttccagggcagcagggctgaggatcccattctggctgtgtccacgtccgggccatggctagagtctgggtttaggggaggaaggcat

SEQ ID NO: 1491 - DNA, 661 bp, Homo sapiens
  misc_feature [331]..[331]: Chromosome 12, SNP identification no. = rs1974752
  misc_feature [331]..[331]: allele = t, in linkage disequilibrium with rs4931434, respectively
  misc_feature [331]..[331]: n is a, t, c or g
tgtggggttcagtcacatttgacccccggctccgtgttcctgtcccctgtagtgtttttgttattagacccttttttctccttggtttaggaatgggggccccagggccacccttgtccaggctccctctaccgtagaggtgagaattccagggagctacaatttgaaaaccactattttatgagccaagtagaacaagaaatgacaactattaaaaaaaataagggatttctgaccagctaacaaccccacagaaaatccgccagggatccagaaatgagactgaggtggcctcagagagctccctcctgaaggggatgctgctgctgtngtcctgcccggcgccttggactgcagtggccggggcctggggtggggatgagggtgcactgaccagcaccgcagcagctgggggaggttggggtgctgttaacgtgccatcttataggtaggaagtggaaatgggagaaagtgtggggtgcctagggaaggaggtgactgagcagggagcctggctgccatcctaacacccagctcactgggcttgagcgacttgagcctggtgccagggcagagtgggtgatgctggggcccaggctggcaccatacttgaggtctgccaggcaggtcaggtaggatggcacatcgaccttgggggact

SEQ ID NO: 1492 - DNA, 661 bp, Homo sapiens
  misc_feature [331]..[331]: Chromosome 12, SNP identification no. = rs2111770
  misc_feature [331]..[331]: allele = c, in linkage disequilibrium with rs4931434, respectively
  misc_feature [331]..[331]: n is a, t, c or g
aaaaaatgaaattactggaaatttggagacagtagggtagttggtagtattaaagaatagtagtgtgcgatggttggtatgataatggtattgcaattttgctttttttttaaaagagttcttggctgggcacagtggctcatgcctgtaatcccagcattttgggatgctaaggcgggaggctcatttgaggccaggagttcatgaccagcttagccaacatggcaaaaccccatttctactaaaaaaaaaaaaaaaaaaaaaaaatacaaaaaattagcctgatgtggtggcacacacctgtaatcccagctactcatgcagctgaagnaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcatttt

SEQ ID NO: 1493 - DNA, 661 bp, Homo sapiens
  misc_feature [331]..[331]: Chromosome 12, SNP identification no. = rs2005900
  misc_feature [331]..[331]: allele = c, in linkage disequilibrium with rs4931434, respectively
  misc_feature [331]..[331]: n is a, t, c or g
aagtaggagaatcacttgaacccaggaggcggacgttgcagtgaactgagattccgccactgcattccagcatggatgacagagcaagactctgtctcaaaaataaataaataaataaataaataaatcataagttcttatcactgggtatggtgtctcatgcctataatcccagcacatttgggaagcacaatttgggaagaattgaagtctttattaagtatttctacccatggatccatgtatttcttcattgatttaggtcttctgtgattttgtttacagcattttgtacattttcagcatacagatcttatatagacttaatcantttttcagagatagtacaaatgcaattattttaaaatgttgattttctgttagttattgttagtatatacaaatgaaattgagttttgtattttgaacttgtgctacttctggaatgtgtgtgcgtgtgtgtgtgtgtgtgtgtgtgtgtgtgtgtgtgtgtgtgtgtgtgtatgtagtccttggaatacaccataaccaagtgggtttttcctgggaatgcaagactgcttcaatacttgaagatcagtcaatgtaatctgccatagtaataatctaacaagaaaatcaacatgatcacatcaattgatatagaaaaaaaatttacaga

SEQ ID NO: 1494 - DNA, 661 bp, Homo sapiens
  misc_feature [331]..[331]: Chromosome 12, SNP identification no. = rs1053552
  misc_feature [331]..[331]: allele = g, in linkage disequilibrium with rs4931434, respectively
  misc_feature [331]..[331]: n is a, t, c or g
tcttttacttttggacttattctatcctgttatcaacttctttcttttcagagaccatgaagtaatctgaacacatcgacacatgacgtactcattagactattagtaattctaatataattaaagaaatttttatcgaaatttcttaagtgtcgatatatacatggaaaatatttagagagtaaaaacaaaacattcaactgtccagtcatttttaaatccgtatatataaacatgtatacacacatatacatatatgtacagatacacggatatatacgtacaaaaataaagatttatagataaatatatatgtatgtttacacaaatnacaaatttactacaaaatttagggtccacctcttcgtaaagaaaattgtttgactaagaagacatagtttggacctttttttagtacttggtagactgtagcacttgtcagacgtcacccgataccaaagaactgttcagaataaaggaatagtagggtaatttacaacagtaaaacgtagactcagatactgaaaaaaaagaaggtcatgagataagtgtcaaaattaggatcttttgcgtccctaaaaaaaaactgtcgttgaacttattaaacgacataccgacagttgagatttaaactcataaatctgtaataccttgtgtctca

SEQ ID NO: 1495 - DNA, 661 bp, Homo sapiens
  misc_feature [331]..[331]: Chromosome 12, SNP identification no. = rs4931434
  misc_feature [331]..[331]: allele = a, c
  misc_feature [331]..[331]: n is a, t, c or g
tgttgaacacaaggttgctctgctcagcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtntctaaagcgcatgccatagtttggcatttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatac

SEQ ID NO: 1496 - DNA, 661 bp, Homo sapiens
  misc_feature [331]..[331]: Chromosome 12, SNP identification no. = rs4244856
  misc_feature [331]..[331]: allele = g, in linkage disequilibrium with rs4931434, respectively
  misc_feature [331]..[331]: n is a, t, c or g
gcagaaaaagtgaaactgtctgctcgaccaaaaacctatcatgacacaaattataattacattgtagcaggtctgagaaaagataatcactgagaaaattatccgcagaagtttatgatctacataattaaatagatctagggtatgattaacttacatattggcaaaataatgagttgttaaccttaaatcatataaaatttcaagttcctttgcttacattgaggtgagaggaatttagctggaagtctcagaggaatgtaggcatttatgtgagtggtaacaatacacatagaaaggatgtctctaaagcgcatgccatagtttggcntttcctcagtaaaataaaaatagaactaccctatgatccagcaatcccatttctgggtatgcatccaaagaaaatgagatgaatattttgaagagacagctgcagtcccatgctaattctttcattaatcacaatagccaacataaggaatcaacctaagcgttcgaaacagatgaatggataatgaaactgaggcatatacacatacaaattattcggccttaaaagaagaaagaatttctgccatttgtaacaacactgaagaacttggaggacattatgtggaatgaaacaaaccagatacacacaaaaaacactgcaggatctcac

SEQ ID NO: 1497 - DNA, 661 bp, Homo sapiens
  misc_feature [331]..[331]: Chromosome 13, SNP identification no. = rs9506845
  misc_feature [331]..[331]: allele = a, in linkage disequilibrium with rs10507308, respectively
  misc_feature [331]..[331]: n is a, t, c or g
ctcatgggtatagcactaataaactaactccattcttctcttaagcttaattaagttttagaaagaacaccaagtagataaacacataagaagctgataaaaacagcacctatttagaaaaatagcactgaaaatattttcatttgttataaaacagtattaaattactagtgctaaaatcaaaactatgtgctcaccagatcctttcttttcttcctggacacatagccaaactacatttctagtctcattgtggttaagtgggaccatgtaactgagttctgaccagtgaaatgtgggcaattataatgtgtgcatttccagggctggnctctcctggaaacatctagaggaagaatccacatccctgcaggactcccaggttttaggaggtggcaaaaccatacataaaagtatcctgaatccctgcatcatttcatggtggatgttgtcaaaggatgccactcacactggaacacctgcagtagaagttgtatgaataaaaaattaaacaattactatgataagccactgtgatattgggtttgtttgttagagggattagccaatataaaactggcaatttctttttgctgtcttgatatatttacaagaatgactcagctttgaaaagaaactagagatatgtatctcaaatgga

SEQ ID NO: 1498 - DNA, 661 bp, Homo sapiens
  misc_feature [331]..[331]: Chromosome 13, SNP identification no. = rs2038713
  misc_feature [331]..[331]: allele = c, in linkage disequilibrium with rs10507308, respectively
  misc_feature [331]..[331]: n is a, t, c or g
aatcaagtatataccaaagagtagaatgctggaatgagataataagcaggattaaagtcttgaattgagctttcaaatctcatttattcatggaatgtgagggtcatgttgcccagcagttctctctctctgtctctctctttctctttctctgccagcctctctctctcttctctctttctctgcctctctctctctctctctgtgtgttgaacgaggaggatagcaaatcattggcttctatttttagttacccatgaacttaaaaacaatgaaaacagtgacatttctttcaactgtagtaacagtctctaactgtgctaataggctntgaatgctgcatcaaggaagatgtcacggcactgttttcagccctggtcagatctgggacacagtgttcaatctggccagcaccatttcaaagagctgtttacaaaatgagtgtgagggatctgaaaattacaaacaccacataggggaaacatcatagagctggggatatttagacaggataggagaaggcccttggggaacaagctcactgccttttacgtagctgaagtcccgtcatgctgaagatgtcatagacttgttttgcactcctcttggaaggtagaactatgaacaattgtcaaaaggcacaaaagagcaaactggctta

SEQ ID NO: 1499 - DNA, 661 bp, Homo sapiens
  misc_feature [331]..[331]: Chromosome 13, SNP identification no. = rs692783
  misc_feature [331]..[331]: allele = g, in linkage disequilibrium with rs10507308, respectively
  misc_feature [331]..[331]: n is a, t, c or g
cttcattgtgcacacaaatgatctttggtttattgccatttgcagctcttacttaagtggaggaaggaaatttcctcaccccatttcctagtgttccaagctcaataggtctaccccttgctctacttttatcattatgtcacatatttcaaagttatgtagttcatctttgaatgcatgttttccatttttcttcttatattatgttcatcctgtttcttactgtaatgcaaagaaaaatgtatattcaggttaaattcatctaacttctggcaagtgtaagagactatgtgagactcatattttgtatcattaaacctgcaaaattatntgagatatgcattactagtctcacgatgggaaaattgagtctcataaagaggaactatatctccaagtccaatagcaagttcatgttggagaaggacatttaggtggttctgaatgggctgtgtcttacttatccctctgacctcatctcatactacttctctctttccccactaagctgtaggcataatggctttatttctctttatcaaatactccaagctctttctcatcctaagaactttgcattaactctcccctctgcccgataatcttttcatgatgatcaacatattggtggccccttcctttcattttgatttcactgtaa

SEQ ID NO: 1500 - DNA, 661 bp, Homo sapiens
  misc_feature [331]..[331]: Chromosome 13, SNP identification no. = rs573671
  misc_feature [331]..[331]: allele = c, in linkage disequilibrium with rs10507308, respectively
  misc_feature [331]..[331]: n is a, t, c or g
ttggtttattgccatttgcagctcttacttaagtggaggaaggaaatttcctcaccccatttcctagtgttccaagctcaataggtctaccccttgctctacttttatcattatgtcacatatttcaaagttatgtagttcatctttgaatgcatgttttccatttttcttcttatattatgttcatcctgtttcttactgtaatgcaaagaaaaatgtatattcaggttaaattcatctaacttctggcaagtgtaagagactatgtgagactcatattttgtatcattaaacctgcaaaattatgtgagatatgcattactagtctcangatgggaaaattgagtctcataaagaggaactatatctccaagtccaatagcaagttcatgttggagaaggacatttaggtggttctgaatgggctgtgtcttacttatccctctgacctcatctcatactacttctctctttccccactaagctgtaggcataatggctttatttctctttatcaaatactccaagctctttctcatcctaagaactttgcattaactctcccctctgcccgataatcttttcatgatgatcaacatattggtggccccttcctttcattttgatttcactgtaaatatcacctcctccaataattctt

SEQ ID NO: 1501 - DNA, 661 bp, Homo sapiens
  misc_feature [331]..[331]: Chromosome 13, SNP identification no. = rs1886088
  misc_feature [331]..[331]: allele = t, in linkage disequilibrium with rs10507308, respectively
  misc_feature [331]..[331]: n is a, t, c or g
attttttactagtcttatataaaaggattttgcttctgttctatttggatatagttgttgggtcttcggagttctatgttttcttaccattcttttaaaattataagtttttcttgattgtaacttttataatcatgaaaaacaaatgcctttcgcatatttgccacccaaagagaacaactgttttggtgtatttctttttatatttgttttacatatgtaaaatcactgcaaatattgaattttaggtactgaaatcagataaactggttcataaattttcagtttataactaatgccaaatgttcccaataagaggagataacaattnacttaactagtttgtcaacactgaatatagaataggtttatatcttccctttttttcatataaagctgttttatattttagattatttttaatctgagtatatgttgtaaattcagatttttattgcagatgattgccttattgaacagtgagaaagggtgagaaaattttaagttgcttaaataactatttccagactgttttcagaagtttgggacatatattgcctcagcaacgcatacataagatttctatttcacatacacccatcagcattagataacatgttagaaatagaactctaattttgccagtgaaaaaatagatttc

SEQ ID NO: 1502 - DNA, 661 bp, Homo sapiens
  misc_feature [331]..[331]: Chromosome 13, SNP identification no. = rs9316962
  misc_feature [331]..[331]: allele = t, in linkage disequilibrium with rs10507308, respectively
  misc_feature [331]..[331]: n is a, t, c or g
tatcacagacattcttacaggatgcaaaaacctgatgatagtattggtaatgacctggccaactgacagcaggcaacaatgttcttaacaagcagggcctgagtgagcaaagaactgtgaggctgagtccatcagtacaggggcagatccaatctttatttaaaagtggagcattttcttcatcatgaacttttttttgcatttgattcttgtaaatattgcattaaatactatgcattttgattaccaaatttactgacacctcttaaattctgtgctagcagcaaatgcctctcttgtcttaccctaccatgtctctattaaggagtangataaacccctgtagaaacaggagtacagtagataaaagttaggacaatctctatacagaaatttaactcatctgctagaaggtactagagaaaaagaaaagaaaacgcaattctccccaaattaccttggatcctgggagaatagtggtgccatccaagtctctagctaacgctttagccacggttacatttgcattcatctgttacttttgaacaggttctatgcccatactacttctgtacttttaaatgataaaataatttttattctgaagtagcatattcaaattatttttccttaagagattattttgaaatgtggggttgat

SEQ ID NO: 1503 - DNA, 661 bp, Homo sapiens
  misc_feature [331]..[331]: Chromosome 13, SNP identification no. = rs10507308
  misc_feature [331]..[331]: allele = a, g
  misc_feature [331]..[331]: n is a, t, c or g
tggcagagggcacattcatcatccctggggaagtgtgtttgtgggagcagctgtgagaggacactgcgcagaaggaccgaggggcctgttggtacatttgccagcttgatctgctttgtggtaataaactccaggaatgtctaaacctggacttgtccaaaagaagaaggttgtttttgttggaatgtctgggttttattcatgttccccaagattcccatttcagaatctttaaattttatgggtatttttaaagctataaaacagtgagttcttaaatatgcttctaggacatagaaccccccaaaagtctagatttggttcaccaagnaagtccacgccagatactttgaccgtcatctgaaccactcccctccccgcccaccacaattcaacattttccactcataacatcatgacattataactgtgctctctggcagttgtgtcattggtgattagtaaaacactgaaacaatgacatcatgtctataaaataatcacaaaaaatgccgaatattagtgactaagtctcagaatggaatttgagcaacgcctgtagtgactaggttcactttatatattctgatcttgcagaattcgagtaagtttaccttctacctccttctctttccctaattttgcccttcccccatttctc

SEQ ID NO: 1504 - DNA, 661 bp, Homo sapiens
  STARD13
  misc_feature [331]..[331]: Chromosome 13, SNP identification no. = rs797227
  misc_feature [331]..[331]: allele = a, in linkage disequilibrium with rs797206, respectively
  misc_feature [331]..[331]: n is a, t, c or g
gtgtggttggtgacttgaatgactcattttgtcacttttacaaacgatctggtccgatggtcacctttgtgacctatagagggaaaagttggtcaactaaagtcgggggtttactgataaccagaggaatctgattgtccctaccccacgagaattcttagtccagtggaatacacccaccaccactatcccgatccctcacacgaacctccgttctccgcagtcgggatgtatttggtacatcttctccgaggaacgtctttctccaaggcaatagtcttatgcatcccttcctacaacctgtctgtttttatctatggacggtctctcnttttactttattaataatgtatcttatcaatgtttttaatgtatctttagaaaagtattatggttcgacttacctaacctaaaagtggtcgtttcgtcgtgtcattggaggcatctctaaccacccgggaagacaggtccaggtgagagaccaaagtgaggtgtgagtccaaaaggtactctgtcgatgtcactcgactccgaaacggaacgtcgggacctcgacgatgtccccacccattcccatcgtttacctcttgtttattttgacagttttacactaaaattatcgagaattacgaaaatgtattataatacgaccgatcgttct

SEQ ID NO: 1505 - DNA, 661 bp, Homo sapiens
  STARD13
  misc_feature [331]..[331]: Chromosome 13, SNP identification no. = rs797222
  misc_feature [331]..[331]: allele = t, in linkage disequilibrium with rs797206, respectively
  misc_feature [331]..[331]: n is a, t, c or g
actaactaggtctatactgtcaacgactcttcaatgtacgtctttcggaacgtctccctcagtcttcgaagtcggttcgacatagatagaacggtacagttggggttttcctcgtttccttaacttttcccggacgtcttcataacctcactgaaataggattgtcttagacacgaggaagaaagtggatgtaccgttccaaaaggggacgatagtactttagaagaacccattaacctcatggttctcgattttttctcaactcgtttagtttgtcgtctattggagaatgttcgtatctgtaagtctttacagacttttctatgtcctnctcaaacgtagggatttttgtgcgtaaaaaaattgtaaattttttctttttagaatttcgttacatcctaccttctcatggacagttttcgattctttagactgaaggatcaccaccaccctaaacaggtttcgtcaacgagaaggggtccgttctttagtagtcgtactgtgtctcactcatgggtgtccgggaagactatgaccagtaaaccggttaaaacaccttcaacctcgagccgagactctcggttatagttctgtcgttggacctgagaacaagtggtggaaaggatgtcttcgacctctttgacttaatctctccctctct

SEQ ID NO: 1506 - DNA, 661 bp, Homo sapiens
  STARD13
  misc_feature [331]..[331]: Chromosome 13, SNP identification no. = rs797211
  misc_feature [331]..[331]: allele = c, in linkage disequilibrium with rs797206, respectively
  misc_feature [331]..[331]: n is a, t, c or g
catgtttctcatttattccgttggagacgggagtttctcgacaccagattaccccctctctctacacattgttcttgtaaagtcatattagattcctggtattacttacacactttcaggtctcttctcggctcgattggaccctatgtctactacagaagcgatttagaactatctctatttacactcgttcagtcctccatttatccctctccttacactgtctacctctcctttgtcacattcgtgtccgcaccctatacgttgtcgtcggaccctgacccctagaggcccgtcgaagtgcactgacgtgcactcggggtcttcgtgngtctccggtccgtccttccgtgacacccggcaccactacccgaccatgaaataagacgtccactgtccctctgcacttcctcaaactttctcttacttgtatcaaagtgcaatctctaagttccttccgttcttgacttcgttcctctcgataacccaagacaacgtcttcaggaccaaatctgttttactctcagatttggttcgagcaggtcgggtgccggggtccggcgtacgtcgggtcctaccgaaacttacaccgggttgtgtttaaacatttaaaagaattttgtaaaactctaaaaaaaacattaaaaaaaaaatcgagtag

SEQ ID NO: 1507 - DNA, 661 bp, Homo sapiens
  STARD13
  misc_feature [331]..[331]: Chromosome 13, SNP identification no. = rs797208
  misc_feature [331]..[331]: allele = c, in linkage disequilibrium with rs797206, respectively
  misc_feature [331]..[331]: n is a, t, c or g
gaagggtgggtaaaagaaacgttcggatccttgcgccccgaaagaccgtctaaattgtccatcaaaccaccacagacctaacacgattatcttcggtaatatggtttctattaaaaattttggatcttaaatcatttgttcccaaaaaaaacaaagtaaaacaaaacgataaaactctaacaattagagtttatgagagttaaacgactaaagtaataacacaatcctgtattcactctattacttcacctattaattactgtatgagaaatcctacatttattttcggtgtgaggtgtcttttttcttcatggtatttcgaattttctcnagtgcttggaatcatggacgtaatatgttactcctatcaaaagcatggctccttttccttccttcagagaatcttagtagtagaaacgacgaaaatcagttgacaccttacaaaattttgacataaataccagaatttcccgtacattcttttataaacctttaaagttcgttttctaattggtgaccttaatactatctttagcgtgacaaagaaatgctctcctctcaagacaagcgatgattttctgagacaactcttacacttactcaccttgtatggggtggaatgtaaaatcaggagaaatccccaaactaagtaatctttcac

SEQ ID NO: 1508 - DNA, 661 bp, Homo sapiens
  STARD13
  misc_feature [331]..[331]: Chromosome 13, SNP identification no. = rs797206
  misc_feature [331]..[331]: allele = g, a
  misc_feature [331]..[331]: n is a, t, c or g
ggagacagtaagagaagtgtagggggtccagttacgagaatttgtctttgccttcaattcggtgttccaatctcctgtccttcactgagttactaaggaacccccagtccacagacccatcactctctttcttccctctcttttaaggtctaatcttttcatcgggtctaccctctcactagtcccgtccttaaagtctttgctgttactgtagtcgtaatcaccatgaggaggtgagaggatgtgttcgtgaattctcgcaacgacacttgatgaagggtgggtaaaagaaacgttcggatccttgcgccccgaaagaccgtctaaattntccatcaaaccaccacagacctaacacgattatcttcggtaatatggtttctattaaaaattttggatcttaaatcatttgttcccaaaaaaaacaaagtaaaacaaaacgataaaactctaacaattagagtttatgagagttaaacgactaaagtaataacacaatcctgtattcactctattacttcacctattaattactgtatgagaaatcctacatttattttcggtgtgaggtgtcttttttcttcatggtatttcgaattttctctagtgcttggaatcatggacgtaatatgttactcctatcaaaagcatggctcctttt

SEQ ID NO: 1509 - DNA, 661 bp, Homo sapiens
  STARD13
  misc_feature [331]..[331]: Chromosome 13, SNP identification no. = rs797201
  misc_feature [331]..[331]: allele = a, in linkage disequilibrium with rs797206, respectively
  misc_feature [331]..[331]: n is a, t, c or g
ttctagaaactaccaagttgaaaaggaagaggaagattagtgattgttgaaagtaaaagtaattcgggacgacatatctactagagaaaagaatgaggagtatgatgtacgacgacaccacttgtacacataaatcaccgactaatttcatacttatttatttacttctttaatacactccttaacaaacaggaaagaagtcaacgtaaaaataaatattaaatatgggaggaagaaaatttttctacaaaattttcgaaacggtaaaagagtaggtgaataagggtaaatcaatacttactcccgatcttaaactcgttttcgacaccanactcaatatcgtagggtaaacactggaacccgtggagtaacttggagggactaggatcgaagaaggaggtattctacccttaccattatggaaaaaaaaaactctgtctcaaagcgagaaaaacgggtgcgacctcacgtcaccacgttagagccgagtgacgttggagacggaggacccaagttcgttagcaggacggagtcggagggttcatcgaccctaatgtccgcacgtggtggtgtgggtcgattaaaacataaaaatcatctctaccgcaaagaggtaaaatcagtccaaccagaacttgagggctggagtccactaggcggg

SEQ ID NO: 1510 - DNA, 661 bp, Homo sapiens
  misc_feature [331]..[331]: Chromosome 13, SNP identification no. = rs7325308
  misc_feature [331]..[331]: allele = t, t, in linkage disequilibrium with rs4941537, rs1087, respectively
  misc_feature [331]..[331]: n is a, t, c or g
gaaatggctaattccacatcttaggcaagaaatgtacaaaatgattctgaaacatcttctaatactaggaaatagggaagctgttttttttaaagctggattgtgtcaatatgtttaggagtccatttgaaaaggttcctattggccagagatgatataactggggcatctgtatgaataataatggcagtggattgaagcaaatcaaaaatgtgtaaatctgcgagtttttaattacatagattttaaaaactcagctaacttcaggggtgactggtaagtagagggaaagaataagtgtttatctcccctttcctgtatgaactgcgtntcacaacaaccaagctatcgatgaggaaaatttctctttctaggaggcttccagtttataaatggagaaagaatgatggaaccagatcattatcattttgcaacagctgataaaatagtgggcacagacaacaacagttaatggctactgacatcacaaagagactatcagacattataggcttccttttggaatatacaacaccagcacgaaatatttctgccaaataatctaacctcattgtattcaagtctctgctccttacagaagctctctctttatctaaactgggaggcagctgggaatttggattgaagaggagggctggga

SEQ ID NO: 1511 - DNA, 661 bp, Homo sapiens
  misc_feature [331]..[331]: Chromosome 13, SNP identification no. = rs2075427
  misc_feature [331]..[331]: allele = t, t, in linkage disequilibrium with rs4941537, rs1087, respectively
  misc_feature [331]..[331]: n is a, t, c or g
tatatatttctttatttcttcccagtcgttttgattaagacggaccaaattcaacttttttttcatacttgcctgtaatctcccgacctcttggtcagaacttaaatacgttggtcctcatcccgggtttggggtgacgtcctagtgagggtacaccacccgtggtgatacggagacccgtacccaagacgtagaatgggaaatatatgtctcgggtctaccagggtgctcctcgggaccgtgacgacggagggagtcgtcttacctctgacaccgtcgacggaaaaggaagagaccgacgacttaactttcaggaaacatcgtcgagacnaaccacctcggactagtgtaccggggtcgacgtctccctccgacccttccactcaaagaaggaacttagaccccttcgtgtctaagtgatccacctcttaggggacttcgtatccttcctacaagtttctacgaattgactttcttcttgtttataagtgttgttttaagttcaaatgagtaccgttaaagtgagacttcacgagacgtttaacttacaccgttgtaacagttccctatggtgggagtcggtgaactccttacccgtgtcctcgataaccaactcactgatgcacggttcgtgaaagggtaagacatagagtagttgaag

SEQ ID NO: 1512 - DNA, 661 bp, Homo sapiens
  misc_feature [331]..[331]: Chromosome 13, SNP identification no. = rs1080107
  misc_feature [331]..[331]: allele = a, in linkage disequilibrium with rs4941537, respectively
  misc_feature [331]..[331]: n is a, t, c or g
cctcgtaccacggttgtagatcgttcctagaagtacgacacagtagggtaccgtctttcaccttcccgttttctcgtattctcactcgttttctccttttcctgatttcagtaggaaaaaaaagaagttcttaagtgaagaagttactggataagagagttattgtcgtaattaggcaaatgctcccgattcggcaatactagattagtgaagaatgtccagggtggagagttgtgacaacgtaacttctaattcaaaggttgtgtacttgaaaccccccagttttagtttggtaccttacgagaaaaagagtgtttactaaacgacttgncaaacggggtgactggttatacctaatttatgggtaactgaactacactattttaaaattagttcagaggggtgaggggtcttcgaggacctagaactgggtgggtactcgaatttcttgttccttgttgggaaggaactgaaggggaggactcttagtcgactaatgttctgttctatgaaggattggtcgacacggtagtgtggtaggtaagatacagggtagtgtggtaggtaagattcaggggtgtagacaggagagaacgaacactttcttttcgggagaaacgaactgaaaactacgaagtccagtataccagtctcacaagaa

SEQ ID NO: 1513 - DNA, 661 bp, Homo sapiens
  misc_feature [331]..[331]: Chromosome 13, SNP identification no. = rs6561274
  misc_feature [331]..[331]: allele = t, t, in linkage disequilibrium with rs4941537, rs1087, respectively
  misc_feature [331]..[331]: n is a, t, c or g
tgaattacatttcagtgttatgaaaaaaaccctgggcatttgggattttcattcaaataaaatattatttcagcctacttatggataagattaggttgaagtctttttgattcaatatagatgtttttagttcacaattttcaatgtttaaaactgtgtccaactgaataagtcttaaagcagctcatctaccatgtaaatttgtatgtacttagatttcagagagttcattatttaaacttatatcttaatgtgttttatgaacctgttgttaaagtcattaaagtcagttactacttatactcagcaggttcatttcaattcgtagtanttaagctgttctcacagttaaaataccaaaaaggcttactcaatattatgcaccaacagcaggaaaaaaacattttcataactgaagtaactttcaatttatgcatacaaaacacattcaagatcaagaaaatgcctcctactcatcctgtatatcataaacaaaggaattttttcttcccacacagagagataaagaggaaagaaagaaatttccacacagtttttggagtgggtgtcagggagacagaagaacggtatccatggctcgtagttatcagtcactctgaaaacaggcatctctgcctaacctgggcttaaggaatggaag

SEQ ID NO: 1514 - DNA, 661 bp, Homo sapiens
  misc_feature [331]..[331]: Chromosome 13, SNP identification no. = rs9534258
  misc_feature [331]..[331]: allele = g, g, in linkage disequilibrium with rs4941537, rs1087, respectively
  misc_feature [331]..[331]: n is a, t, c or g
actcttgacctcaggtgatccacccaccttggcctcccaaagtgctgagattgcaggcataagccaccacgcccagcctctaactcagaatttaaaaggaaatgaaatataggttcagccaatcacaggcagctaactggcatttagttacattgtcttgagcttcccactgggatagttccaataaggtaattgctcaaacttaaccaatcaaaacacgtctttgttcagtgtctgcactggccctctagaagctttcaatgcaaccacctcaggtggtgccccaaccacttatggtttggaactgcctgattcaggaatcaccgtttgnttaaataaactctaaattttaatatgccaatgcttatcttttaccaataatatggaaaataggctgacacctatacaaccaactagagtcctaatttaggagatgtgatatcgtagagactgtaatagtccaatgtactgtagaggcatgttataacagacaaaaacaaagtgtggagagaacagttaatttggaatgggaagagaaaggtttcattgaaaaagtgcgaagaatgtatcggaaggataaacacaaacttaataggtgaaggaggtattggagggatggtcagcaggggtcagtcagtattcaagggggaggaagaaacag

SEQ ID NO: 1515 - DNA, 661 bp, Homo sapiens
  KIAA0853
  misc_feature [331]..[331]: Chromosome 13, SNP identification no. = rs4460970
  misc_feature [331]..[331]: allele = t, t, in linkage disequilibrium with rs4941537, rs1087, respectively
  misc_feature [331]..[331]: n is a, t, c or g
tctaaacaaagtaatttaaaaacttgcaaacatttaaaaaatttactcgaagcttaaatcttagttcatattatttagctcattatataaactttacaacagtgaggtaaaaatacaagaagtgtctaattctctctcaacatctcaattcctcctccctatctcaatgatcttcttgcattgatgaacacaatttttagaaaaatgctttaatacaattaaaaataactttgttagttccactagtgtatgttctatttttttattttaccaacttttttcaaccacctatgctaaactttgtctcttggtgagttagttgtgaacttantcctaaaattacagaatacacttaacgtttacaatcactagctaaccatacatttcactgaatctacaatactaagtttcaaaatgtaaccatatgctttatgggtatgaatttgcagcaaataaaatataagaagttatgagatgtttctagtcattctagtgattttccatgttattaaattctataataatctccccatatcctcactaagtcacttctaatgtaaccaattttagtaactttgtcatataaacatacatctaaacataaatgcacataataggattttcaacttttcaagttgatccaactcattttcctactttg

SEQ ID NO: 1516 - DNA, 661 bp, Homo sapiens
  KIAA0853
  misc_feature [331]..[331]: Chromosome 13, SNP identification no. = rs4941537
  misc_feature [331]..[331]: allele = g, in linkage disequilibrium with rs1087, respectively
  misc_feature [331]..[331]: n is a, t, c or g
acataatttacctttttccatattctatgtaactttctatgttccatattgtctctatatgttctatatatttctatattctacatatacatttctctctataaatatccaaatatataaatcattttaagaaaaattcctctctcaaagttctaataaataaaaaaaaaagtttccttgtctatttccactataaccataaaatatcttccaagaagtacataaaatgattaggcattaatagaactaatcactccattatttgatctcctcctactcccctatcttattttctgtggtcaaaagaggcagccttgactgcatgaagaanagcaggaaggttaaaatcataggcatcaataagggacttgaacacataaacccttccaccaagacatactactaaaatcctgatattaaactgattaacactactgtatgtatttctattataatgttggtattaatgtgataacaggtaacattttgatagggcagctaaacttttctttaaaaagttgcataaaatttaaggcagcatgtaaagtaaccaatttagcattactttagaattaaaatgtgtataaaatatactaacctaggaaacagtgactagatcacaattcaattttattacctgaagaagtacttcgactgggtt

SEQ ID NO: 1517 - DNA, 661 bp, Homo sapiens
  KIAA0853
  misc_feature [331]..[331]: Chromosome 13, SNP identification no. = rs9534265
  misc_feature [331]..[331]: allele = c, c, in linkage disequilibrium with rs4941537, rs1087, respectively
  misc_feature [331]..[331]: n is a, t, c or g
cttgtaccctaaaagctattgaaataaaaataaaacaaaaacataccagcacatgtatatcatagacagctcctttatatagatgaacaaccatgtggagaaggccccaggtgtaatatgacaactcacaggcccaagcttgtgtactactttatccaaagctcctctcccatcaataactggcctatttccccatttttcatatctaatgacttgctatgacaagagaatgtggtgaaagtgacactgtgcaaatgtgaagaggattcaggaggccttgctgcttcagcttctgccctcttgttgtttctaccattacatgcaaagcagngtttagactactgaaggccagggggtcaagtggaggagaaacaagatgccctaattgccagacacatgaatgagacaatcctgggcctccaggcccagctgcattgtcagatgtaatgttgatacaggagttactccaagtgagaccaacagaacaaccactctattgagcccaggcaaaactgccaatccacagaatcatgagcaaataaatggttgttgttttaagctactaacttatgtggtgatgtgttatatatcaagagataactgacagactggaataaagtgaaaatttaaaacatgagaaaaagttatttcaaggaaatac

SEQ ID NO: 1518 - DNA, 661 bp, Homo sapiens
  KIAA0853
  misc_feature [331]..[331]: Chromosome 13, SNP identification no. = rs4942460
  misc_feature [331]..[331]: allele = c, c, in linkage disequilibrium with rs4941537, rs1087, respectively
  misc_feature [331]..[331]: n is a, t, c or g
acttaatatccaagtaacaatcgcccctagaccttaaattttttaaagataatttttatttgccctctaacgaccatgtttcctgctccccgtcaacccccttcccccctcccactgatcaatctttgatctttctctgcatgctccctaccctacctccagcccactgctccaaccccactttctgccatctctacccttcacctctgatcttctctgtccccccagcaggacctgagaacactggtggcaaaggataggggcagcaggaggtgtagaacataggagctgaaggaaaaaaaaaatttccctcgtaagtcacacctctaanttcaggccaaaatatatacacatcaaagtgcagctattatgtgaggaaaatatagtagaacaaaacatatgtcagaatttgttgctgcaatataacatgaactgtaatattaagggtactgatgtctagcaatcttgaaataaatgtaaaaagtgtttcatattagtgatatatatttgtaattaataaccaattactaataaattagctttaattacataaatgattactcagatgaagagctgttttcttaaaatgttaactgataacctcatcacattttatataaattttttccatgtacacacaaatcacataaacacagagtaa

SEQ ID NO: 1519 - DNA, 661 bp, Homo sapiens
  KIAA0853
  misc_feature [331]..[331]: Chromosome 13, SNP identification no. = rs9316177
  misc_feature [331]..[331]: allele = c, c, in linkage disequilibrium with rs4941537, rs1087, respectively
  misc_feature [331]..[331]: n is a, t, c or g
ttagtatgtttaataatgttaatggagttttcattcaataagtagtcattaaatatgtactatattcctggtcaactctagttgttaaatatcttattaaaatttatagaaaggtacaatataagagaattttcccatcttaccaatgtttcataaacactgctgtgctgacctagttccaaaatcatacatacaaaaaaaaaattctatcaaataggtgctttctccagtccctgcctattttcttgaatatcattctcatccgccattttcttgaacaaaagaacccgactgattattgcttgcattgttgataggaagagaatactanattcaacatgtttcataggagactgccgtactccactcaccaagaggcgcttaaagtgcatattaaatataaatgttgttccaagtaagcatttcctgagtacttactatgttaaaaaatgaacacaggagaagttagaaaacagacttattaagttgaatctacgaagaccagaagcttagacaagaagtaaagaaagagatgagagctattaaacaggctttattgccaggtaacaataaaatctcagcttgaatagggagtagcaaatccaaagttaacttaattctcagggatctagaaaggaaaactgcttcgcttacttcttta

SEQ ID NO: 1520 - DNA, 661 bp, Homo sapiens
  KIAA0853
  misc_feature [331]..[331]: Chromosome 13, SNP identification no. = rs9534272
  misc_feature [331]..[331]: allele = c, c, in linkage disequilibrium with rs4941537, rs1087, respectively
  misc_feature [331]..[331]: n is a, t, c or g
acattaataatagcaagtaacgtatattgctactatgtgtgtgacactattttaagtgcttgtcatatattaactcacttaatctttatgacaatctaataaggtaattgaatgtcatggttaattttatgtgtcaacttaatccatttatgcctagtgttccattattggaatactaaacttgtgggagttatttatatcctactgctcaaggtctcatggccaaggtctgatttttcacaaaaaaatttgcaacttctgacataactgggttaactgggtcatggaatggcccagatatctggctaaacattatttctgggcacgtctntgagggcttcctaaaagagtctggcatttgaaatcagtaaactgagtaaagcagatggccctgaccaatgtgtgtatcatctgatctactgagggcctgaacagaacaaaaaggtgaaggaaggttacattctctgcctgactgcttgagctgaacgttgatctacccttgcttctcaggtcttacactctgaatggaggcagctttctacctctcacgcttctgaattacaccaccagctttcctgggtctccagcttgcagccagatcacagggctttatagcctccataattgcatgagccaattccttaagtaaatctcattctag

SEQ ID NO: 1521 - DNA, 661 bp, Homo sapiens
  KIAA0853
  misc_feature [331]..[331]: Chromosome 13, SNP identification no. = rs4941538
  misc_feature [331]..[331]: allele = t, t, in linkage disequilibrium with rs4941537, rs1087, respectively
  misc_feature [331]..[331]: n is a, t, c or g
tccttagatcacaactgtccgtctcaacggatctgatgccatatttctatttccatttatattttctgatgaaaagctatgaagattggttaaaaaatcaagagtggtgtgtagatctatttcattaaaatacatagaagttgctggcactagcacccaaacccatcacgctcatttgccataaatgcccaggagcctagaggtgggaatttcattgaccacgatggacttgactgaccacaaactgaggtgccttctcaagatatacttctagcactttagatcatatcttaaccttgggaaaagaaataaaatgaagaactaaaaaaanaacaaacataagaagtcctacttgactgcttaaaacccaagaaaatgaacatcactgttatatattgctcaaatgcattagaatgacaactatccattcatgcttggggactgagagggtaactatatatattcactacctgtgtgactaagcttgattactcatcttatgttggagtacaatgacaatttctcagtaaatatatgaaataggctaaagcatgtttttcagtcagaaagcaattactaaatatttaattaagggcaagtagttttcactagataaaatgaagacactgaatttaattaagtgaatactagctatctccag

SEQ ID NO: 1522 - DNA, 661 bp, Homo sapiens
  KIAA0853
  misc_feature [331]..[331]: Chromosome 13, SNP identification no. = rs1409436
  misc_feature [331]..[331]: allele = c, c, in linkage disequilibrium with rs4941537, rs1087, respectively
  misc_feature [331]..[331]: n is a, t, c or g
ctacaactcgtagaagaacacatgaataaccgataaacatataaaagaaacctctaagaaaagggtaaaatttttagctcaacagaaaaataataactcaatgttcacaagagaaataaaacctatgttcagggaatagcatatacattgaacgtctagaaaagagggtaagacacacaatagtagtgtaagaactaccacaggaaatttcgtatgtgtaaaaattaaactactttagactgaatggacaaaaacaaaaaaaacaataataacaacgaacaaacacgaaaaccacagtagattctttgataacaaatcaggtcccagtgtntctaaatgcagatacaacagaaacttcgtaaaagaccaaaatcgagaatataaattcggaaactatgtaaaactcgattaaaaataaatactacaccatttccaagtcggaataagaaaacgtacacctataggtcaacaggagataatatcagaaaaatactttcaatgacttaacattgacttagttccttcgttgttgaaggaactagtgaatttaatacatcttcaaaagacgtcgacaaaaactgggtaccattttttcgggactgtcgtaatattaaacactttgaataaagaatgttatgtcaaaattcataaatcaaaagat

SEQ ID NO: 1523 - DNA, 661 bp, Homo sapiens
  KIAA0853
  misc_feature [331]..[331]: Chromosome 13, SNP identification no. = rs3783200
  misc_feature [331]..[331]: allele = c, c, in linkage disequilibrium with rs4941537, rs1087, respectively
  misc_feature [331]..[331]: n is a, t, c or g
acagttttcccaggggactctttccctctaaattacattatccatatagaacattataatgccgtattacacatttaccatatatttagcacacaatatttaaaatgaaactcaaattaacaaatcactactgaagttgaactttgttttgggaaattcaatcctaccctaacaggtgaggatgactcctctgtatttcgtttctggggctcagtgtccacgtcttggcgcttgttcttcattctttctctaagatcccctgtaggtctttctggtgacctttgaaccaaaacacagaaacaaaacaaaaaacgaaacaaaacaacaaaantctgtatttatatattaataacattttataagaatgtatttacagaaataacctcacaaatctcaatacactttttctaactgaccttgactcctgaatttctgaaaaatttcaccttaaatattaatatgcaaaacacgagcaacacttacagtttttctcccaataacaatcaaaatgtatatgttaaattccacgaagtggcaggtactggtgatgtgaataagaaattatatgtgaactgagaaaaaggaactaatagcttgacttgttttcctattaatcacataaatatattagttatatgtgggagcaaaatgtagtagtaac

SEQ ID NO: 1524 - DNA, 661 bp, Homo sapiens
  KIAA0853
  misc_feature [331]..[331]: Chromosome 13, SNP identification no. = rs1087
  misc_feature [331]..[331]: allele = t, in linkage disequilibrium with rs4941537, respectively
  misc_feature [331]..[331]: n is a, t, c or g
tctctttttattacataattccttaccataaacagctgttgtaaatgcgcaaaatgcggcatttgttgacagtacctagagccactcattcattcgttcaacagtgtttattgagcagctgagctggaatgagaggctatgtttgtcgtttttgacacccctcccctttctgggccatcgcctaattaccgtggagcaaacggaatgcatggttgtatttctaaaggcacaagcagaaatttattgaaaatttggagcagaaatctttaatgtacttctgaccacccttccttttgttgagtaggatccaatgatcagcgtgagatgatcnttgattaaacttgcttgagatggctagtcaaacgtcgaaacttgcttgagatggctagtcaaacgtcgaaaatcaaagaaaaagtaggtaactagacttttacaattttttttaaagggtaaaaagacatgaaccctagtctgccttaatggcaaagtagcacttattaggttctctgacagaaccaaggaataggaaaatcttttatcaaaactacggataaaacttaaaaataatttgatacaatgatttggtcttgctggaatcagtaaattaaaatacggaagcagaatgataaaatcaggggcattaaacattcctaatgacatg

SEQ ID NO: 1525 - DNA, 661 bp, Homo sapiens
  CPB2
  misc_feature [331]..[331]: Chromosome 13, SNP identification no. = rs9534304
  misc_feature [331]..[331]: allele = c, c, in linkage disequilibrium with rs4941537, rs1087, respectively
  misc_feature [331]..[331]: n is a, t, c or g
ttccatgtttccaatcacaccaactaatcttattcctcttagtatttatatgtgctactcaagtaggtttttctaaatttatatatacctagttatgtttctatgtgcccctctttaaattagaaagcagagtatttcatattgcttgagtaattttacatgaatcacaatgttgagtaaccagaaaatacagacagaagagcatgttaaactacaagatggtaatgcaattagcaaatcctgataatgggaaactcttttctttgacaaataaattgcaaggaaaaaaagaagagagagaaagagcaaaagatggaatgtgagttcatgnattaaaatagaattaaaagacatataaaccaatcataatgtaagagccttatttggatccagaatcaaagaaacatactttttaaaaagttaggaggccgggcgaggtggctcatgcctgtaatctcagcacgttgggaggccgaggcaggtgcatcacaagggcaggagtttgagaccagcctggccaatatggtgaaaccctgtctctactaaaaatacaaaaagcttagccaggcatggtggcaggcacccgtagtcccagtggctcaggaggctgaggcagaaaaatctcttgaacccgggaggtggaggttgcagtgagccgaga

SEQ ID NO: 1526 - DNA, 661 bp, Homo sapiens
  CPB2
  misc_feature [331]..[331]: Chromosome 13, SNP identification no. = rs9526136
  misc_feature [331]..[331]: allele = c, c, in linkage disequilibrium with rs4941537, rs1087, respectively
  misc_feature [331]..[331]: n is a, t, c or g
aaaatacaaaaagcttagccaggcatggtggcaggcacccgtagtcccagtggctcaggaggctgaggcagaaaaatctcttgaacccgggaggtggaggttgcagtgagccgagatcgtgccactgcactccagcctgggcgacagagcaagacaccatctcaaaaaaaaaaaaaaaaaaaagttattatacaattgaaaatactggcaatattttatggtattcagaaacagctagtttttaaggtataattatactataattatttttttcagagttcttttttttttagaaatgcatactgaaatatttattgatgaagtgatatgntacctaggatttacttcaaaataaaatgagtaaggtagaagtgggtagagagaatacagatgaaacaagactggtcatgagttaattattgttgaagctctatgatgggtagatagaagtttactacacaattatgtgcacttatatatatatttgacattttccacaataaaagttaaaaaaaattaataataaagccattgtgcctagatccagaattctatgaataattcaacctgtatatcctatatccccaaggagaacatgatttgtcttctttgccttttctcctacctttttccatgagtagtcataaccatccacattaac

SEQ ID NO: 1527 - DNA, 661 bp, Homo sapiens
  CPB2
  misc_feature [331]..[331]: Chromosome 13, SNP identification no. = rs9316179
  misc_feature [331]..[331]: allele = g, g, in linkage disequilibrium with rs4941537, rs1087, respectively
  misc_feature [331]..[331]: n is a, t, c or g
gaagtgatatggtacctaggatttacttcaaaataaaatgagtaaggtagaagtgggtagagagaatacagatgaaacaagactggtcatgagttaattattgttgaagctctatgatgggtagatagaagtttactacacaattatgtgcacttatatatatatttgacattttccacaataaaagttaaaaaaaattaataataaagccattgtgcctagatccagaattctatgaataattcaacctgtatatcctatatccccaaggagaacatgatttgtcttctttgccttttctcctacctttttccatgagtagtcataaccntccacattaaccactggcataacatagaaatccacaagcctcaggagattggtatattgccctattatcccatagaattgagttatctgcaaattaaaccaagtatatttaattagatgttttaagttcttctaaacttagtgtgtttctttttcttttttttaatttgtcatttggcatgtttagatttgcagatttaactttcagaaagagtgctaattcctcaaaagaactgaacttagggtgctacgaagtggtgataaatgccttacacgtggtccagtattcctagttaatgaaggcagacaatcgaaccataaactttctaaa

SEQ ID NO: 1528 - DNA, 661 bp, Homo sapiens
  CPB2
  misc_feature [331]..[331]: Chromosome 13, SNP identification no. = rs9316180
  misc_feature [331]..[331]: allele = g, g, in linkage disequilibrium with rs4941537, rs1087, respectively
  misc_feature [331]..[331]: n is a, t, c or g
tagatccagaattctatgaataattcaacctgtatatcctatatccccaaggagaacatgatttgtcttctttgccttttctcctacctttttccatgagtagtcataaccatccacattaaccactggcataacatagaaatccacaagcctcaggagattggtatattgccctattatcccatagaattgagttatctgcaaattaaaccaagtatatttaattagatgttttaagttcttctaaacttagtgtgtttctttttcttttttttaatttgtcatttggcatgtttagatttgcagatttaactttcagaaagagtgctanttcctcaaaagaactgaacttagggtgctacgaagtggtgataaatgccttacacgtggtccagtattcctagttaatgaaggcagacaatcgaaccataaactttctaaattttccttaaaaaataaaattaattctttattaaagccatagagcccactaagaagatttaaggaaacaaaaacctagatttagtttagctcctttttctgtaattcatgttcatcagagcttaaactacctaccatgttttatccccagatgtgattacatgatattggctacattgtccttagaacttgtggagctcaagttttgctagaattgagt

SEQ ID NO: 1529 - DNA, 661 bp, Homo sapiens
  CPB2
  misc_feature [331]..[331]: Chromosome 13, SNP identification no. = rs9534305
  misc_feature [331]..[331]: allele = a, in linkage disequilibrium with rs1087, respectively
  misc_feature [331]..[331]: n is a, t, c or g
attaaagccatagagcccactaagaagatttaaggaaacaaaaacctagatttagtttagctcctttttctgtaattcatgttcatcagagcttaaactacctaccatgttttatccccagatgtgattacatgatattggctacattgtccttagaacttgtggagctcaagttttgctagaattgagtgtgtttcccaaggctttgatcatctagctgtagaattagggtagcttttcctaggaactggctatgaattcctaacggacatcatctcaaacttgttcctctctactttagagtcatccagcttagtggcacatattgcantgtgatccaatggcatccaaatttggtgactgagaagtttaccccaaaatgacaaaatgtacaggcaggagaactataaagacaaattttagctggtcaaatcgtttcatctaggacaaagcttttggttcaaaatcttaatttgtggcaacattgctatattttaatttaattcacatttaattacattaaatatttaatttagtttataattgtttgttgccttaaagcatactcatgacattgttaagaaatgtctttttcattattgacaaaataaaaacaagccttttataaactttactattttccctttaaacgtttaaaata

SEQ ID NO: 1530 - DNA, 661 bp, Homo sapiens
  CPB2
  misc_feature [331]..[331]: Chromosome 13, SNP identification no. = rs9562635
  misc_feature [331]..[331]: allele = c, c, in linkage disequilibrium with rs4941537, rs1087, respectively
  misc_feature [331]..[331]: n is a, t, c or g
tgttttgtttttttgtttgtttgttttttattatactttaagttctgggatacatgtgcagaacatgcaggtttgttacatagttatacacgtgccacggtggttagctgcacccatcaacccgtcatctacattaggtatttctcctaatgctctccctcccctagccccccacccccgacaggccccggtgtgtgatgttcccctccctgtgtccatgtgttctcattgttcagctcccacttatgagtgagaacatgtggtgtttggttttctgctcttgtgttagtttgctgagaatgatggtttccagggaagccatgttttaaanagtcgagcaaccagttaaatacatttttatgttacgaatttataaatttatgttagcatcacttttcagtaataatgtagcattcattattagaaaaatattaggagagcctgttccttttaaaataataaagcaaataataaagcatttctcattttcatttctacaacatgggccaaacttttaatagatgcagcatatgaatttctttttctgcttcactttttaaatttccttcctacctttacctctggttggatgggaatctttctacaaaaagttatgctctgagagattaccgatgttaggcccagaacaatgttacctatt

SEQ ID NO: 1531 - DNA, 661 bp, Homo sapiens
  CPB2
  misc_feature [331]..[331]: Chromosome 13, SNP identification no. = rs7988836
  misc_feature [331]..[331]: allele = g, g, in linkage disequilibrium with rs4941537, rs1087, respectively
  misc_feature [331]..[331]: n is a, t, c or g
tgttagcatcacttttcagtaataatgtagcattcattattagaaaaatattaggagagcctgttccttttaaaataataaagcaaataataaagcatttctcattttcatttctacaacatgggccaaacttttaatagatgcagcatatgaatttctttttctgcttcactttttaaatttccttcctacctttacctctggttggatgggaatctttctacaaaaagttatgctctgagagattaccgatgttaggcccagaacaatgttacctatttctttatctaataggtaggactccagacagaaggagtgagtgagggctganatacagtctgtgctgtgtgccaagccacaccttcaagtgtggctatagctacaatcccgaaggaaggggtgcccattttttctttaacagcttattgagatataatttacattccagaaattcaccattttaaagtgtgaaattcagcggtttttggtgtattcatagagttttgcaaccatcactaatatctgatttttggaacatttcatcataaaaaatccccatgcctatgcccattataactcactcccctttccctcctgccatttccccaagcctctgacaatcactaatgaactttctgtctctgtggatttgcccattctg

SEQ ID NO: 1532 - DNA, 661 bp, Homo sapiens
  CPB2
  misc_feature [331]..[331]: Chromosome 13, SNP identification no. = rs7993537
  misc_feature [331]..[331]: allele = g, g, in linkage disequilibrium with rs4941537, rs1087, respectively
  misc_feature [331]..[331]: n is a, t, c or g
ctacctttacctctggttggatgggaatctttctacaaaaagttatgctctgagagattaccgatgttaggcccagaacaatgttacctatttctttatctaataggtaggactccagacagaaggagtgagtgagggctgaaatacagtctgtgctgtgtgccaagccacaccttcaagtgtggctatagctacaatcccgaaggaaggggtgcccattttttctttaacagcttattgagatataatttacattccagaaattcaccattttaaagtgtgaaattcagcggtttttggtgtattcatagagttttgcaaccatcactantatctgatttttggaacatttcatcataaaaaatccccatgcctatgcccattataactcactcccctttccctcctgccatttccccaagcctctgacaatcactaatgaactttctgtctctgtggatttgcccattctggacatttcatataaatggaataatatatgtggcattttgtatctggtttcttttacttagcatagtattttcaagattcatctatgttgtagcatgaatcagtatttcattccttttgattgctgattgatgtttcattgcatgaatatgctgcattttgtttttctgctcataagttgatggaaatt

SEQ ID NO: 1533 - DNA, 661 bp, Homo sapiens
  CPB2
  misc_feature [331]..[331]: Chromosome 13, SNP identification no. = rs9534307
  misc_feature [331]..[331]: allele = t, t, in linkage disequilibrium with rs4941537, rs1087, respectively
  misc_feature [331]..[331]: n is a, t, c or g
aatcagtatttcattccttttgattgctgattgatgtttcattgcatgaatatgctgcattttgtttttctgctcataagttgatggaaatttgagttgtttccactttttgactattatgaataatattgctataatcatttgtcaacatatgtgttcacttgtcttgggtatacacctaggagtagaactgctgggtcatatggtaactctatacttaatcttttgaggaacttccacattgtttttcaaagtgactgaagaaattttgcctgacgacaaataaatatttgttgaaggtacgatttaccaacatggcaagtaacataantgaaatcctgtcctactagagttggtctgcaatatacaatgacttcacttatgattttttgactttacaatagcgcaaaagcaatgcatattcagtagaaaccatacccatgccaccattccatttttcagttttagtgcagtatttaataagtgatatggatattcagcaatttattataaattaggctctgtgttagaagattttgccctactgtaggctaacgtaagtgttctgagcacatttaaggaaggttaggctatgatattcagtattcggtagattaggtatattaaatgcattttttacttagaatattttcagttgtga

SEQ ID NO: 1534 - DNA, 661 bp, Homo sapiens
  CPB2
  misc_feature [331]..[331]: Chromosome 13, SNP identification no. = rs9526140
  misc_feature [331]..[331]: allele = a, a, in linkage disequilibrium with rs4941537, rs1087, respectively
  misc_feature [331]..[331]: n is a, t, c or g
attgctgattgatgtttcattgcatgaatatgctgcattttgtttttctgctcataagttgatggaaatttgagttgtttccactttttgactattatgaataatattgctataatcatttgtcaacatatgtgttcacttgtcttgggtatacacctaggagtagaactgctgggtcatatggtaactctatacttaatcttttgaggaacttccacattgtttttcaaagtgactgaagaaattttgcctgacgacaaataaatatttgttgaaggtacgatttaccaacatggcaagtaacataactgaaatcctgtcctactagagntggtctgcaatatacaatgacttcacttatgattttttgactttacaatagcgcaaaagcaatgcatattcagtagaaaccatacccatgccaccattccatttttcagttttagtgcagtatttaataagtgatatggatattcagcaatttattataaattaggctctgtgttagaagattttgccctactgtaggctaacgtaagtgttctgagcacatttaaggaaggttaggctatgatattcagtattcggtagattaggtatattaaatgcattttttacttagaatattttcagttgtgattgtttattgggtatattgaga

SEQ ID NO: 1535 - DNA, 661 bp, Homo sapiens
  CPB2
  misc_feature [331]..[331]: Chromosome 13, SNP identification no. = rs9316181
  misc_feature [331]..[331]: allele = a, a, in linkage disequilibrium with rs4941537, rs1087, respectively
  misc_feature [331]..[331]: n is a, t, c or g
atgctaaggttgaaaaaaaagcagtcatagtaggggtgagaaatgagagaagacaggaaattaagaagttacattgctagatggcttcttctaacattccttgttgctgtccatggccacattctgggtctaaggatcagcaaaacattacttctgagatccagaggatggctacaggagaaatctgctaaagaggagttgagatgaggtttagtagaacagagaacaaggaactgtgaagatacattgttaggtgactctcacacatggactttgaattcactcagaatgatggcaagagttggaggggaataaagaatcatgaaccggntaccaggaaattatctgaaggtcagtgcacgatagcaataaaataagagtgcaaccagtttgtgtaagtttctgagaagagaaggatcattggtagtatcaggagaagagaatgctgatctactccaccaggcctctcagcacatggtgatgtgaaaaaaagagcagcccctctacttgaaggagccaccagggagcagtgtccttaggtcatgtgtcagctgtggtgaggaggggcagagataattctgtgaaggccctgaggttgtagagctctaactttgtgtgcaattagatgagagttttctagggcagaggtttggcaggaggt

SEQ ID NO: 1536 - DNA, 661 bp, Homo sapiens
  CPB2
  misc_feature [331]..[331]: Chromosome 13, SNP identification no. = rs1409434
  misc_feature [331]..[331]: allele = g, g, in linkage disequilibrium with rs4941537, rs1087, respectively
  misc_feature [331]..[331]: n is a, t, c or g
gagatgggtttgacgaacgacttagaaacattctaatttaataaattaggtgtttataaatatctaacggatactacaaagtctaggacctttatgttcctacttgttttatatcgggttcctagaatatcgactcataaaacgaggttgttacacttggactaaacacatcgggtttctttgtattagttattcccgaaaaatttagctgtaaatttgaggtaagaacggacggattttgattaagtctagtagactgagagaatcatgaagtttcgtgacctcctccctttcattttattttataaatggaaagttgttaacacttccntccaaaatataagtttttgatttggtgggtttccgtttaattttagaatcgaaaattcagagagtgagaaaagatgttgagttattcctaaagtttttagaatattagatcagagtcacctttaggtgatgtgatgtgaaactcttcgaacttcggtcagtaaagaaagattcgaagagtaagtacatgagagccctccgtttaaatctaggaagagaaaggcgtttccgtctcgactctggttaaacacgtactgacgtagtggttcggttttaggccgtgtcccgaccgtgtagtatcctgggtcacttatatacaattggtagtgtt

SEQ ID NO: 1537 - DNA, 661 bp, Homo sapiens
  CPB2
  misc_feature [331]..[331]: Chromosome 13, SNP identification no. = rs3742264
  misc_feature [331]..[331]: allele = t, t, in linkage disequilibrium with rs4941537, rs1087, respectively
  misc_feature [331]..[331]: n is a, t, c or g
tttagctccaggcagaaatgtagaaaagaccaaaaatattttgggtgatttaaatgcttgaagtcatgttcttcaacttactaatgcataaaagtcacctgggaaacttgtgaaaattgtagattcccaagcttcatgatgtgacctaggaaaatgcattttaataaatagcccagttgagtctgacacaggtgatcttgggcaccattttgagaaatagggttaagagaatgtgaatacttacatggcctatgaaccacaagcagaaagcaggagagatccattctctggcatggattccacagtcaatccatatggcatttttggctgnttgttcttttccagaaacctgctcaaagaaaccccaaaagtagcaaaaacagtaacaataagcttcaggataataactttcatttatatagtgcttatatttaatagtttcagcaaatctctgagatatgcattgttctgcatttctttgaaaattctcaagggaaatttaaacactggtgatactaagtgacattagttaaggtagcaaagctggtgtgaattgaaactgaagtttgaagccaggactctttgatttaaaactgtttttatcctccacaattatgcagtcatgtcagagctgcatgtggaagtttcaaagaagagacca

SEQ ID NO: 1538 - DNA, 661 bp, Homo sapiens
  CPB2
  misc_feature [331]..[331]: Chromosome 13, SNP identification no. = rs9567613
  misc_feature [331]..[331]: allele = g, g, in linkage disequilibrium with rs4941537, rs1087, respectively
  misc_feature [331]..[331]: n is a, t, c or g
aagcattgctcaggcagtaatgcttgctcgctggctattcatctccagttgcgtggccgcgttcctaacaggccatggactggtacctgtctgcagcccaggggttgaggaccactggtatagagggaagggagaagactgttgtaaaatcaaacaaatatgtagacttgcaattccaaaataagaaaaagaaagagttagatatttagattgtcatttgaaccactccaggaggttttttcctaacttggagctagcaatatttaacaggatagtaagtaagaaagcccaatggcattggccactaatcgtcaaattgtatagtcaaagngaactacctagcttaatctactcaatgcaaagaaaatcttaagttgtctggattcgttactttacttgacctttctaagtcctgggccaattttcttggcactggttctgacaccgaaaagttggcaaaatcccagagactcacattatctgcacatccttgatcaagtaagagtaggaccaaaccatccagaatgcatgatttttcaacgtgtacaggttccagataagtatgttccaaggactacacacaacatggctgaaagcaaatgtcatgggtggatatgccatgatacatggatccaatctgattgaccaactcagtgaccaa

SEQ ID NO: 1539 - DNA, 661 bp, Homo sapiens
  CPB2
  misc_feature [331]..[331]: Chromosome 13, SNP identification no. = rs11618062
  misc_feature [331]..[331]: allele = g, g, in linkage disequilibrium with rs4941537, rs1087, respectively
  misc_feature [331]..[331]: n is a, t, c or g
caattccaaaataagaaaaagaaagagttagatatttagattgtcatttgaaccactccaggaggttttttcctaacttggagctagcaatatttaacaggatagtaagtaagaaagcccaatggcattggccactaatcgtcaaattgtatagtcaaagagaactacctagcttaatctactcaatgcaaagaaaatcttaagttgtctggattcgttactttacttgacctttctaagtcctgggccaattttcttggcactggttctgacaccgaaaagttggcaaaatcccagagactcacattatctgcacatccttgatcaagtnagagtaggaccaaaccatccagaatgcatgatttttcaacgtgtacaggttccagataagtatgttccaaggactacacacaacatggctgaaagcaaatgtcatgggtggatatgccatgatacatggatccaatctgattgaccaactcagtgaccaaggggacccaacatttcatatgtctgccttgagtctgcactgtaagttcttgtaaacgacagattaaaattgagaagtcctaacccaaagtcttatctttgaatgactgaagaggctcacctatcacaatttagataatattgggatactgtgcataaattatatgttact

SEQ ID NO: 1540 - DNA, 661 bp, Homo sapiens
  CPB2
  misc_feature [331]..[331]: Chromosome 13, SNP identification no. = rs9534312
  misc_feature [331]..[331]: allele = c, c, in linkage disequilibrium with rs4941537, rs1087, respectively
  misc_feature [331]..[331]: n is a, t, c or g
atatgttactaaattaaatgtacatttttagtgactacattattttccagagctttaaaaaaaattttttttaagagagagaggtagaaaacagaactatagagttgtttcctagttctgaaaacaattggctgtggctatgttcactgacctttactaaggtcaatttattcaagagagaagacatccaatccaagttaggttaatcaatttctcttgcataatattttgcaactgaaaataaataaccaaatgggtggaaattggagtagaaaccatcataagaaccctactgcaaaggacttcagccttgtccggctgtttgtccctngctgggatttgttgtcctggtcttactttagtttcaaaagctgtaccaggaagtactaaccagagcaaacaggtaagagaaagaaataaaaggcatctaaattggaagggaaaaatcaaattatccttggttttagatgacacgatcttatatttagaaaaacctagcctccaccaaaaaactgtgttagaactgataaattcagtaaattgcaggttataaaatcagcacacaaaatcagtagcatttatatacaacaatagcagacaacctaaaagaaaaatcaagaaagaaataccatttacaatgaccaaaaaaaaaaacctataa

SEQ ID NO: 1541 - DNA, 661 bp, Homo sapiens
  CPB2
  misc_feature [331]..[331]: Chromosome 13, SNP identification no. = rs9567615
  misc_feature [331]..[331]: allele = c, c, in linkage disequilibrium with rs4941537, rs1087, respectively
  misc_feature [331]..[331]: n is a, t, c or g
aaagagaaaaaaaattctaaaattcatatggagccataagagatcttgaaaatccaaagcaatgctgaacagaatgagcaaagctggagtactaaaacagcatggtactggcataaaaacagacacatggaccaatggattagaatagagaacccagaaataaatccacagatctacagttaactcattttcaacaaaggcaccaagaacatacattgggaaaaggacagtcttgtcaataaatggtattgggaaaaattttattcataaaattcaaactaaatgcctatctctcgccttatatataaaatcaactaaaaacagattaganttaaatgtaatacctaaaactataaaactactagaagaaaacattgggaaaacaattcaggactttggtctcagcaaagattttttgggtaagatctcaaaagcacagtcaacagaagcaaaaatagataaaggggattacatcaaactgaaaatttgcttctgcacagcaaaggaaataacagcgtgaaaagaaaaaaatgggagaaaatatgtgcaagctatccagccaacagggacttaataaccagaatatataaggaacgcaaacaattcaaaaggaaaaaaacaaataatccaattttaaaaatgagaaaggaatctgaacaga

SEQ ID NO: 1542 - DNA, 661 bp, Homo sapiens
  CPB2
  misc_feature [331]..[331]: Chromosome 13, SNP identification no. = rs9567618
  misc_feature [331]..[331]: allele = t, t, in linkage disequilibrium with rs4941537, rs1087, respectively
  misc_feature [331]..[331]: n is a, t, c or g
agtcttgtcaataaatggtattgggaaaaattttattcataaaattcaaactaaatgcctatctctcgccttatatataaaatcaactaaaaacagattagaattaaatgtaatacctaaaactataaaactactagaagaaaacattgggaaaacaattcaggactttggtctcagcaaagattttttgggtaagatctcaaaagcacagtcaacagaagcaaaaatagataaaggggattacatcaaactgaaaatttgcttctgcacagcaaaggaaataacagcgtgaaaagaaaaaaatgggagaaaatatgtgcaagctatccanccaacagggacttaataaccagaatatataaggaacgcaaacaattcaaaaggaaaaaaacaaataatccaattttaaaaatgagaaaggaatctgaacagacatttctcaaaagaagacacacaaatgggcaacaggtatatgaaaaaatcctcaacatcactaatcatcagggaaatgtgaattaaaaccacaatgcaatgtcatctcattccagttaaaatggcttttatccaaaagacaggcaattacgaatgctagagaggatgtggagaaaggggaacccttgtacactgttggtaggaatgtaaattagttcagccactatga

SEQ ID NO: 1543 - DNA, 661 bp, Homo sapiens
  CPB2
  misc_feature [331]..[331]: Chromosome 13, SNP identification no. = rs1326398
  misc_feature [331]..[331]: allele = t, t, in linkage disequilibrium with rs4941537, rs1087, respectively
  misc_feature [331]..[331]: n is a, t, c or g
ttaaatattgactctccgtaggactatacgaatgtttttaggtgtaacctaggagtaaactcttcatgggtgagatacaaaatttccatacaacacccctttcaacaactagaaagtgacactcccctccctaattaagaggtcagcacaaacaattttgaactcaaacaaaggaaactcaagacttttataaacgtaatgttcacaaggagttgaaattatggaccgataaatccccaaccaataaaaagggtaattattatatcagaacaggaccagacatacaggattagaggagggtgttcctgtggtcagtcagacctaatcatgngtgggattcccggagtacaattgaattagtggagaaatttccgggatagaggtttatgtcagagatcccccaattccgaagttaagatctacttagggtcaagatcttaattgagacaaagacaaatacactgtaatctattcggtaaattgtaaaggtattttacttccttcaccacaaataaaaaaagttcaggaacaaaataaaagcaatcacctgtttgtgataaagacaatcccctgtttgtgattgtcttttattttgtccctgaacttttttattttaatttttaatttttttcaccacgtcgaaaaactacaattaaaaatt

SEQ ID NO: 1544 - DNA, 661 bp, Homo sapiens
  CPB2
  misc_feature [331]..[331]: Chromosome 13, SNP identification no. = rs723391
  misc_feature [331]..[331]: allele = c, c, in linkage disequilibrium with rs4941537, rs1087, respectively
  misc_feature [331]..[331]: n is a, t, c or g
aaaaaaaggaaagaaaaggcatatgaggaagaacgctgtgagatggcaactacctacaagctgaggaaagaggcctcagtagaaaccaaacctactgacaccttgatcttctagcctctagaatcatgagaaaacaaatttctgtgatttcagctacacagtctgtggtattttattaccacagccctagaaaactaatagagccatgtgcttattttttcctcctgtgtcattccaactctttcctgaacatatcgtaagaaaacataacttttttgaacaaaataattaaaatatgttttaacaaatatttaaaaatacttctgtttanggcattcccctctccccaccaaacttatcacagcagtgacagtttcaccttttatgaaggtgaaatcccacctatgaagcctctctgcatcaagtttgctcatgcagtcgtgctgatggatgctggagagaggtggtctaagttggatagatgtaggagagattaaaaaagggggggtgcaattttaaggccccctcaatcaaccaggcacacattctagaagcatactgactctggcttaattaactgggaaggaacagatgcttttaaagattatatacataaaattgattctcattacctaagtcttagatgtcttaaaaatatgga

SEQ ID NO: 1545 - DNA, 661 bp, Homo sapiens
  CPB2
  misc_feature [331]..[331]: Chromosome 13, SNP identification no. = rs9534322
  misc_feature [331]..[331]: allele = c, in linkage disequilibrium with rs4941537, respectively
  misc_feature [331]..[331]: n is a, t, c or g
tttgccggggtagagtctcaggcatatggtattcagctattgcgctggatatgtcagtcggaaaaagcatcagaacagttaacatccacttgggacagacaccagtgcatatttacagtcttgcctcagctttaattaactttctcactctccagctgcaagatgtgtacttgatataagcccccagctactgtgctctgaaatctgtccctgtgttagtgctaataccacatttcccactggcttcttgcagctaataactgagtatggtggggatactaagggaggctctttctacaaaactggaaactcttctgatgtgtgactctgnctataggacttttttttttttttttttttttgagacagagttttgctcttgtcacccaggctggagtgcaatggagcaatcttggctcactacaattctgcctcgtgggttcaagtgattctcctgcctcagcctctcgagtaactgggattacaggcacgcaccaccacacctggctaatttttgtatttttagtaaaaacggggattcaccatattggtaaggctggtctcgaactcctgacctcaggtaatccacacacctcggcctctcaaagtgctgggattacaggtgtgagccaccgtgcctggccaggactcttggttggtt

SEQ ID NO: 1546 - DNA, 661 bp, Homo sapiens
  CPB2
  misc_feature [331]..[331]: Chromosome 13, SNP identification no. = rs1952187
  misc_feature [331]..[331]: allele = a, a, in linkage disequilibrium with rs4941537, rs1087, respectively
  misc_feature [331]..[331]: n is a, t, c or g
tggagcaatcatgttttttttttatgaggattcaatccaacgtcaaacaatacatcgctgagttcaatgctccgtaggagtctggtttaaatcaaattaaattgtaataaatatccttttgttgacggagtggagaaggtgtttgtgtggaatgagaaaaagaacaatcagaaaaagagctcaagattgaagaatctcaacacactctgtagaaataaccccttcggagacctggtcctgtctacgaagaaacagatccaaaagtgaacgctgaggtaggaaggggcgattctcagaacgaagatggagacccgagaacaacaactcttgnaaggtagggaaatccaccgggataacctaccgtagattgtaattcacaaagaaaagtaaaattgatgatgatagatcggttgatctctggtcggtgtacgtccaaatcgaaatagtcctcttcggtccgtggtcagaaacacagacatttaaactcctttgtaggttgagagagtaatagaggaccttcagggggatgatccgactccattcccctcacgtggggctttgaagtagggaaaccctcccaccactgaatgtcttggtatttttgtacgatttttttttttaagtgtttaggagagggagaaaggtgagactgtcgaaaaat

SEQ ID NO: 1547 - DNA, 661 bp, Homo sapiens
  ARG2
  misc_feature [331]..[331]: Chromosome 14, SNP identification no. = rs12436474
  misc_feature [331]..[331]: allele = c, in linkage disequilibrium with rs10483802, respectively
  misc_feature [331]..[331]: n is a, t, c or g
gctgtctgagcactagatccaaaatgcagatttgatttgtcttcctggcttagaaaccacggttgttccccaccacatttaggacctgggccttgccccggctcctgccgcatctctttgcagtcctctaggtgcactctgggttcggaggaattgtgcattgttctatagggctgaaggcattctctcctcctcagtaagcatttcttcctcctctcttattcctggctaatgtcttccagactcagatattgctgcttctgagaagttctcctgacccttctcttcctgggtctctgttcccgccacaccctttgtacatctggttcanagcaattagcactgggctgggctgccactttctctgcctgacatcctaccagcctgtgacctccttgaagtctgcaccataccttatttctgcattcctaggatttagtggagtgctaggcacagagtatacttttgttgaaggaaaaaaggaagcaaagcatcttagctttctcctgtaacttcattcacatcacaacccttgatgagttttcccaaaccagtattttgtttctctgaaaatgatctgctacttagaagccacctggtctcccagatttttaaaacgtatgactcaaaggataactgccatatatcaaactttaactct

SEQ ID NO: 1548 - DNA, 661 bp, Homo sapiens
  ARG2
  misc_feature [331]..[331]: Chromosome 14, SNP identification no. = rs8010798
  misc_feature [331]..[331]: allele = c, in linkage disequilibrium with rs10483802, respectively
  misc_feature [331]..[331]: n is a, t, c or g
cctgttgtcgggggactaacctatcgagaaggcatgtatattgctgaggaaatacacaatacaggtatgtagcaaccaggtctgcagcctgttaactacataggtaaatatgctagagtctcttgcctgcaaaggatcttttctgctattccacatcattgcagagtttgtttttgcttaaacttttgtagctaaaaattatatggccatgctaataaaaaggatatagtcctttagagtcatgcttggacatggctcttaccaaattacactaaggtaataatgagtaaaaaattgtatatttaaacaattaaatacaagaataaattgncaaactgatgcagttctttgagttatctaaaggcagattaagataagaaggcaagataagataagagtgcaaggctgtaatttgcactctaagagattggttcattgggagttgtgaatttggagctaaagctgatctcttgaagaaatctgcaaactggacaatatcttgggtcctttatgtagggtaggtcttgtactagagcctgaaaggatttctaataagggggatacagttagatgagaatggctgatggaaagagtactaagatgaattctacgttatcaagactggctacttttccaaaactcatacttgtttgcaaacagt

SEQ ID NO: 1549 - DNA, 661 bp, Homo sapiens
  ARG2
  misc_feature [331]..[331]: Chromosome 14, SNP identification no. = rs10483802
  misc_feature [331]..[331]: allele = c, t
  misc_feature [331]..[331]: n is a, t, c or g
acattttgccaacaagcaggatgaaaacctcccccacccaacaccaagccttttccttttccagaacgcctgacaattatgcctgttatgttagttgaacagggatggtttatttcattatcttaaaaggtttcttttaatctactatagcacaacagtgttttaacttaaattcatggccaagaggatgaggtgcaaggggcttcctaaaaataggtattttctactataaaatggactcttgtttttactttggcttgttctccctgtcccagtgggatgaccctcactgagagtagcagcaagggaacctgaggttttgtcacacttngttcttccagggttgctatcagcactggatcttgttgaagtcaatcctcagttggccacctcagaggaagaggcgaagactacagctaacctggcagtagatgtgattgcttcaagctttggtcagacaagagaaggagggcatattgtctatgaccaacttcctactcccagttcaccagatgaatcagaaaatcaagcacgtgtgagaatttaggagacactgtgcactgacatgtttcacaacaggcattccagaattatgaggcattgaggggatagatgaatactaaatggttgtctgggtcaatactgccttaatgagaacatt

SEQ ID NO: 1550 - DNA, 661 bp, Homo sapiens
  ARG2
  misc_feature [331]..[331]: Chromosome 14, SNP identification no. = rs15493
  misc_feature [331]..[331]: allele = t, in linkage disequilibrium with rs10483802, respectively
  misc_feature [331]..[331]: n is a, t, c or g
ccttcattgatgataaacttgttgtaaagtcttaggtaaaaatacgaaaccaaaaataacagagtcaaattgtaaagacactccatctgtcacaatagggattcactgtcgatttcttggaatactcatgaaggacgattcaccgacacactagtttgtatgtcggagtctcataggtcggcaccagggtccagattggggttttacaaatcttccttccaataggtttgaagactgatgaggggtgaaacgaagagaaacatctcactgttggttgttcgacgacgaaaggtaatagtagaatgacctcgagcggtaggaccctccggancaaatgatgtttaagaaagcgtcggtaacttgaagatatcccttcccaaacacctggtcttgaaactggaacacttacgtactacaatccctacacctatcttattcgtataacgacgacacccgactgtcaagttcctacgtgacatatcggtccgacaccctcctccctcctttctactttttggtgaatttacacttccttgttgtcgttgttctggtcatactatatggttccattatttacgacaaatactgaagaaatttaaatgtatcatgacatcgtataattatgggacacttgacgttttttggtttatgtaaatgtcat

SEQ ID NO: 1551 - DNA, 661 bp, Homo sapiens
  VTI1B
  misc_feature [331]..[331]: Chromosome 14, SNP identification no. = rs1804799
  misc_feature [331]..[331]: allele = t, in linkage disequilibrium with rs10483802, respectively
  misc_feature [331]..[331]: n is a, t, c or g
tccacatccctaacatcatgcattcacaaggtcaaagttctggtccacaaacccttccctatagaagttcaatggctgcgaaagaatttgtagtaaaccaggcctcccaggatggcgagctccagtaagatgataatggaaagcagcagcttgttggttgtcactctacaaagagaagcaaagtggggagtagtcagaagtttggataaccttccttctaaacattttggggttagacctgggaccacggctggatactctgaggctgtatgtttgatcacacagccacttagcaggaagtactcataaggttctttagctgtcacttagngataacactgtctacctcacagaaatgttaaactgagacaataaaaaccaaagcataaaaatggattctgaaatgttgttcaaatagtagttacttcctttaaaaatagcttttctagaaagaagggttagctagaaaaagtaatcaaatagacatccagctcaggatgggtcctgccctaggataagtaactagaagcctgggtaatacctttcaatcccttgtaaacttcttccctctgccctatttttccctttgctctcctatcaacccaaatgggtatgttataaaggtagtataggagcttaaaaattttcctatctgttgttt

SEQ ID NO: 1552 - DNA, 661 bp, Homo sapiens
  VTI1B
  misc_feature [331]..[331]: Chromosome 14, SNP identification no. = rs17249563
  misc_feature [331]..[331]: allele = c, in linkage disequilibrium with rs10483802, respectively
  misc_feature [331]..[331]: n is a, t, c or g
ctgggattacaggcacccgccaccacgcccagctaatttttgtatttttagtagagacagggtttcaccatgttggccaggctggtctcgaactcctgacctcaggtgatccaccagcctcagcctcccaaggtgctgggattacaggcgtaagccactgtgcccggcgctctgtagcattttcacttaataaatggcatacagaccagtagacgaggaaaccactgaatgaggttcaaataaaaccagttaggttagcgcaaaggaagaaggaaaaaggttttcaaaataaaagatgcagattttcaactgagtaggctaaaaaatgacnaagaaaagatcagatcacataaatgaacttcagacagatttggaacaatactttttctgaaggtatggatacctaaattatgttttaataatttctgaaactcgccaggcgtggtgggtcatgcctgtaatcccagcactttgggaggccgagacgggtggatcacaaggtcaggagatggagatcatcctggctaacacggtgaaaccccgtctctactaaaagtacaaaaaaaaattagccgggcgtggtggtgggcgcctgtagtcccagctacttgggaggctgaggcaggagaatggagtgaacccgggaggtggagcttgcagt

SEQ ID NO: 1553 - DNA, 661 bp, Homo sapiens
  VTI1B
  misc_feature [331]..[331]: Chromosome 14, SNP identification no. = rs12435927
  misc_feature [331]..[331]: allele = a, in linkage disequilibrium with rs10483802, respectively
  misc_feature [331]..[331]: n is a, t, c or g
tattaagaaaagctcccagtactcccattaggaagaagatagttcccacagtctagtggcctggtctttcttaaaacagatgcaaaacagagaaaaggatgcagatgtgcttccttctcagaacttcattgggataagtgggaaattgaaacactgatcttcaacaagcaagaaggaagttcgctggccaaaagagaattttttctccatctgctctcgggtagcaaatacagggccaactatttctgcggagtactagcagcgaccagaattttggccccaatcttaatgagtttgctgaagctagagtatgatgagatggagtcaaagnactcttgcttctatagggctagagcaaaaaaaaaaaaaaaaaaaaagttttttttttttaaagaaaagccacaggtgaagagaagcagttgttaaactgttcagtaaacggaaccaacttctgacaaactttgggtaccaactgagactcatgcatgtcttgcctgaggtaccaactccagctcctatgttgtctcttaagacagaaagggacatggttagaattacctctaaactacattttctgtgacagtaggtttaacaaagaacagtaaccttttttttttttttttttttttgaggcaggtctcactctgtcacccagactgga

SEQ ID NO: 1554 - DNA, 661 bp, Homo sapiens
  RDH11
  misc_feature [331]..[331]: Chromosome 14, SNP identification no. = rs8013234
  misc_feature [331]..[331]: allele = g, in linkage disequilibrium with rs10483802, respectively
  misc_feature [331]..[331]: n is a, t, c or g
ttatccagcaataaaaagaaatgaagtactgacacatgctttagcatggatgacccttgataacattaagctgagtaaaagaagtcagtcacaaaaggccacataccatatgattccatttatatgaaatgtccagtaaaggcaaattcttagagacataaagcagactagtggttgcaggcagaaagaagagccagtgcaaaaatcttaaggcttcaatcaaaagacttttatgttcatttcttgatggtggtctacacggctgctgttggatcttcaaaatgaattaagaatccatagcacaggaaaggctcttcaaaagtcaatccantagtaagttatggatttagagctgactttctttaaaccactcagtcaaaaccaagataaagggttatttttttttttcttaaaatctctagggaagaagaatccagtcactcttggaaaatcaatccagtatactatataaatctatcttcttatacttcagaaccacatttccaactatctgctatacatttctacttgcatgccttatagataacacacatgcaacatgtacagagccaggtttgttacacagtggacaactgttactctttggctgaacattctactttgtttcggcaatagcaacctgatttccttctgcagaatc

SEQ ID NO: 1555 - DNA, 661 bp, Homo sapiens
  RDH11
  misc_feature [331]..[331]: Chromosome 14, SNP identification no. = rs3759768
  misc_feature [331]..[331]: allele = a, in linkage disequilibrium with rs10483802, respectively
  misc_feature [331]..[331]: n is a, t, c or g
tatttcctgggggtgaaagtggagggtgttttaaccaatcaatatctgtctgtgattccttaattgtacccagtaatattttctggtccttttgcataatttccatttggttaaaagacacgggttccaatgaactaatatattttatagcaaattggagaagagagggtttccttcacacaatactaattcctaccaatttaacattagattacctagcaatcatcacattttgtcacattctcattattgtgttacctaatatttgtattgggttttataactttataaaagcctttcatttgttttgttccttattcagtcattcacncatttgacaaacatttatggcattcctatagtgtactaggcactgtgctgatgtccagcaggaagccaggaacacataatctctgctcgcccggagttcatggactgtcagagaagaccttaaataagtaatcactgtaaataaatcatggtgaaggttatgaggaggattagagaaagctctgggagcttttacaagggagaggagttctagatcaggagaggcttatttgaggaaataacatttgagcggaggccagagggaagttagtaggcaagcaacatagacaagagtgtgctgagcagaggaaagaccccacctgagggttca

SEQ ID NO: 1556 - DNA, 661 bp, Homo sapiens
  misc_feature [331]..[331]: Chromosome 14, SNP identification no. = rs12434923
  misc_feature [331]..[331]: allele = t, in linkage disequilibrium with rs10483802, respectively
  misc_feature [331]..[331]: n is a, t, c or g
tcatgtagatacaacatataacatattacatgtatatatgtaaacacatctaaacacacatatatatgcacaaatagagatcttatacctttattttttgatttgtcttttgaaacagggcctcactctgttgcccagggtagagagcagtggtatgaccatggctcactgcagcctggacctcccaggctcaagtgattctcccacctcagcctcctgagtacctgggactacaggtgcgtgccgccatgcccagctaacttaaaaaagttttttttttgtagagtcagagtctcactatgttgccagggctggtcttgagctcctgggngcaaatgatcctcctaccttggcctcccaaagtgctgggactgctggcatgagtcacctcatctggcccttatagttttcattttagaattttagtcatgagatagtaatacaaactcaccagtttataaaagatagttggatctaaattatttttggaaaaaattgggacctgttagttcacatggctaaattttatttgtcccaataggtaatctaatgaaggctgtgagccaaaatttttgggtaaggtagttcgatggcagttttattttaaaaatcttttatccttttattcagtttcaaatgagtttagagttaggtttttaat

SEQ ID NO: 1557 - DNA, 661 bp, Homo sapiens
  misc_feature [331]..[331]: Chromosome 14, SNP identification no. = rs12435352
  misc_feature [331]..[331]: allele = c, in linkage disequilibrium with rs10483802, respectively
  misc_feature [331]..[331]: n is a, t, c or g
taataaaccagaacatcaaccaagacaggaacttcattgatttcaggaggaactcatctgtagcactcagcaggggcatctaagtccaggaacacaatggattttgtgctggcacatgcacaaaggttggaagcaggtctaggtagtccagggaggtcactctgaaatcctgtcagctatgccattttgttgatggaaattaaggctgttgaggcagaaataaattgataaaggtttattggaagccaaatgtgaggatcaatctgggaagacacgccaataaagctgggtgtattccaaagtctgtcgttagaagttggaatgattttanaagaaagtttagaagaagggatggagactcttcatactggagttgtcctttttcattgaatggcacaatacagaggttacagtccttggctacagatgacaacatacaagttaaaatgtccatgtttaagacaatcagtaacacttcatgattcagaaacaaatcagtgtccttttcagtgtcagtaggttacatattaatgtgtacgtcaacagtttgagaaattttcaataagatttgagagactcatcgtaagattctttactcagaaatgctatgtaagccatgaatcataagacttgccccaggtaggctaatttggaagactgc

SEQ ID NO: 1558 - DNA, 661 bp, Homo sapiens
  RDH12
  misc_feature [331]..[331]: Chromosome 14, SNP identification no. = rs2009590
  misc_feature [331]..[331]: allele = c, in linkage disequilibrium with rs10483802, respectively
  misc_feature [331]..[331]: n is a, t, c or g
tccattctgttctattgatttgtctgcctattcacctacctgtacttagtagtatggtttagcattttggtacaacttatcaatgatatgatggtggcctttggattataatatttaacattttattttagcaaagtgtttgtgtattttcataattctagatgccttatggtccttctaatatcttctctccagaggactgtatgctgttcttaaggactctctgcttcctggacaagctcaagctaaggtgagtaccatcttcttaaatgcaaggatcttagatttgagtcaagaagtgtctgctgggaatgatctgatcactccttgntctgttggtcaggtccatgggtttccccaggggcagaaactgtgtcttcctagtatgttgcacaattcctggtgcagagaaacactcagtaaatgtgtgttgaggatgaactgatgaatgaggacatgaacacctgcctgccacagaagtctttcatgcatgggtgttcctggaggctcctctggcttcacaggaagggacagaactgggaaattattcctggggtcctgtcccagctccttgtctattcttctgtccaagagaggaacacagagcgaggaagggcaatgaatcccacttacccttctcccatctcacacacatccagag

SEQ ID NO: 1559 - DNA, 661 bp, Homo sapiens
  RDH12
  misc_feature [331]..[331]: Chromosome 14, SNP identification no. = rs12431676
  misc_feature [331]..[331]: allele = g, in linkage disequilibrium with rs10483802, respectively
  misc_feature [331]..[331]: n is a, t, c or g
acatccagaggcacgatcctagctcacttcaaccttgacctctgagctcaagtgatcctccctactcagcctcccgagtagctaggattacaggcacgcaccaccacacccagataattttttgtagagacagggtctcactaagttgcctaagctcagtcttgaacttctggcctcaagggatccccctaccttgggctctttaccagcattttcttgtatttctcctcatcttcaatagcattcaactgaaacatcacccacgttcatcatctctcccttttctacaccatggccttgagtaaagcaagtgagatagcaagggagatangaatcagaacagctaaccataacagctgactcttatatactgtttagcatatgccagtttcgttttccaccaatgtaataattgaacacttagaacaagtggggatatatatatatatatatatatatatgtataacacatatatatataaaaccatatattatatatataatcatacccattgtacaagtgagaaaactgagttaacagagaggtttagtaacttgcccagggccgtggagcttttaaatagattcagcgctagagtccatgcacttaaacaccatacctttccttgtaatatgcatgtgcgtgtgttaacttcattga

SEQ ID NO: 1560 - DNA, 661 bp, Homo sapiens
  RDH12
  misc_feature [331]..[331]: Chromosome 14, SNP identification no. = rs910315
  misc_feature [331]..[331]: allele = g, in linkage disequilibrium with rs10483802, respectively
  misc_feature [331]..[331]: n is a, t, c or g
gcttttaaatagattcagcgctagagtccatgcacttaaacaccatacctttccttgtaatatgcatgtgcgtgtgttaacttcattgaagtaaaatataaaatgcagaaaagtgcacaagtcgaaagcatacgactcagcagattttcataaagtgagcacacccatgtactagcacccagatgaaagagcagagcactctcagccctccaggagttccagtcatctccctccccagtcactgccccctcctccctaaggttaactgctcttctgacgtctctctccattcttctgggagtttccttcccatcctattttaatccactcntattttaagcatcatggggtttgtggctaaagttagaaatattctatatattccatcttgcagtagaggtggcagtggttgggagaacacatttcctagagaagagaaacaattgaggatggggggtttagggggtacttgctttagtttccccacattctctttgccagtaaacctaagtaagcttcaaaccttgactccatcccctccccaccaggactacatctcccagcaggctgtgctctgacagctcttggatttaaataggattctgggctctgctcagagtcaggctgctgctcagcacccaggacggagaggagcagagaa

SEQ ID NO: 1561 - DNA, 661 bp, Homo sapiens
  RDH12
  misc_feature [331]..[331]: Chromosome 14, SNP identification no. = rs718213
  misc_feature [331]..[331]: allele = t, in linkage disequilibrium with rs10483802, respectively
  misc_feature [331]..[331]: n is a, t, c or g
agatctggatcgtttttctccttctttaagcttttggctcacttgattcatgaatttttaaataccaattagcacaaagtgctaggggaacgtcctctctcttcggtgtgaactctgtccctcaatgctgccaagattggcactatctgttgaaatatagaagtagaaattttagtgctgaatcttatcatgaactcaatgagcaactagagtctgggagtaaagggaagcccagggtgaaatctctttcccattccatgacagaatccagccctgtctgctctgttgtcccgctttgttcaaggcttttcatcagtgcagtatttattcngtgaagcactggaaatagtcttagtgtctgatgagaggggaatggataagtgataatagctaatgttgcttgagtttttataatgtgtttggtactcagttctgagtgtgtaatgtgtattaattcatataatcatcacaaccctgcgaggcaggtaatattaccccaagttttcacatgaaactgaggcgcaagataattaagaaacttgctcaaagtcatatagcttataagtggtagatctgggatttacgccctggcaatctggctctagagctgtgccattcagtatggtagccactagccacatgttgctattgagcacttgaa

SEQ ID NO: 1562 - DNA, 661 bp, Homo sapiens
  misc_feature [331]..[331]: Chromosome 14, SNP identification no. = rs17836863
  misc_feature [331]..[331]: allele = c, in linkage disequilibrium with rs10483802, respectively
  misc_feature [331]..[331]: n is a, t, c or g
tcactgaattaaccaagactggagctgtgctcccttgggacttcttgttacacaacataataaattgaccttattaagtctgtgtcctactgatgctatcgtattatgttgaaccctataaagttgctgacattctaccatttttaacctactttttaatttttttttttacttttttttcttaccattactgctagtccaaggcagatatcttcctgacctacttttatcaccctcaatttcctcatctgccaagtgaatatttgacaactttttcattacatttttctccacccccaagttctgtcatcttccattgatttctgaatangacagatatccatggagaaaactgacctaatatcctagcacagagaatcctaatagtcctggcacacccttacaggtgttcacccaagttttaatctatatgtacaatctattttttctacatatggatatataatctatattagccaaaatgatcagctaagaaaatctcaagagaggaggtacaacttgctctgataggaggagattaattattgtaacaaacaatgttaactttagtggtacaatataataaaagtttatttctcgctcatgtcacattccactgcaggaatgggggtgggagggtggttctgctccccatggccaa

SEQ ID NO: 1563 - DNA, 661 bp, Homo sapiens
  misc_feature [331]..[331]: Chromosome 15, SNP identification no. = rs17423970
  misc_feature [331]..[331]: allele = a, in linkage disequilibrium with rs2469583, respectively
  misc_feature [331]..[331]: n is a, t, c or g
atgcatattttgttacaagacgttatcattgactcacctgattctaaccccttatgggcaaggagtgctagtgcatccctttagaaggaaacatctgatcgagttctgcacacaagagtctgtggtgggactctagcaaatgaaaatccactgagctaaggctatcctctgccagcgcactaaaatatctcctttgtccttgggtaataactgcagttactatttaattaagaaagacttccaaggaagaacaatcaatttgcaaattacgttgggtaaaaagcagccaaagaattgctcagccatcatggtagccgatgcatactaagtnaggggagagttctatcatgcaaggcctgcctgtctcctctctggctttgtggatttacagtctccagagttcatccaaattgtcagatcaagaaattttgttgcatcagtgtatttcttaggtcaggggccaaatccacttggtagaacactgtcgctttatcagtgggagaaatgatcaatctgaaagagaatatataattcatgaccaaatagagaaaagcattaagtcaggaagccgacaccagcccaatttatgacattgctctactaagtgtattccccactgtgtcatccaacggcccatcttgatctaaaaatgcctgttttg

SEQ ID NO: 1564 - DNA, 661 bp, Homo sapiens
  misc_feature [331]..[331]: Chromosome 15, SNP identification no. = rs2081619
  misc_feature [331]..[331]: allele = c, in linkage disequilibrium with rs2469583, respectively
  misc_feature [331]..[331]: n is a, t, c or g
gctacaaacctgaactgcatgttactgtattgaatactgtaggcaattttaacacaatggtatttgtgtatctaaacatagctaaacatggaaatggtacagtaacaatatggtataaaatataaaagtggtatgcctgaataggcacttatgatgaacacagtttgcagaactagcagttgctctaggggtgagtgaatgtgaaggcctaggacattaccgtgcaccactgtagactctacaaatactgtacacataggctacactaaaattgttttttaaaaaccttttctttcttcaataataagttaaccttaatttactgtaactnttttttcctgcaaatgagttactatctccttattcttcatctattctttttttaattattataccttaagttctctgatacatgtgcagaacgtgcaggtttgttacataggtatacatgtgccatggtggtttgctgcacccatcaatccatcatctacattaggtatttctcctaatgctatccttcccctagcctcccaccccctgacaggccctggtgtgtgatgttcccctccctgtgcccatatgttctcattgttcaactcccatttaggagtgagaaagtgcagtgtttggttttctgttcctgtgctagtttgctgagaat

SEQ ID NO: 1565 - DNA, 661 bp, Homo sapiens
  misc_feature [331]..[331]: Chromosome 15, SNP identification no. = rs17424213
  misc_feature [331]..[331]: allele = a, in linkage disequilibrium with rs2469583, respectively
  misc_feature [331]..[331]: n is a, t, c or g
catggatttttgtagtcccccagaggtttctctttggtaatagcttctgtatttatgagtgcctcctttgcgtaaggcactgtgctcttgatgtggatgaacggatgcctaaaacccagttcctgcctttttgaggcctagagcctgtcaggtgacatagaagtaactacacagcaaagttaacagaagtaactatacagcaagaagagtgtatgcaaggtagacacctacaaaaaggagtggtgaattctatccaggaacatcagaaaaggtgtttcaaagaagacgaaatgtgaactaggttttgagggatagagaggagttcacaagnagagacaatgtgggtgagggaagagagagagagcagcaagactcctcggggagctgaagccgcagacacacggggagtcgagagggcgatagcaggagccacaactggaggcaggcctggtcggccatgctcaggcacttgaaatgcatttctcatagataattgaagctctgagggctttttagcaagagaatacaattaatatgcttgaatttagaaaataatatgtggaggttctctgaacaaatgattacggagaagggagtttggaaacaggaagattcattagaaggtttagataataatctaggaaagagaggacaggatgcc

SEQ ID NO: 1566 - DNA, 661 bp, Homo sapiens
  misc_feature [331]..[331]: Chromosome 15, SNP identification no. = rs11070622
  misc_feature [331]..[331]: allele = g, in linkage disequilibrium with rs2469583, respectively
  misc_feature [331]..[331]: n is a, t, c or g
gcagaaagaagatgttttacattcaaacacagtctttttcaatttgagtttgataaatgggctttgctaattatcctccatttgaatccagattcattttctgctcttctcagcttgtgtaaggtgcattgcttcatgccacatcagccctggggtgtctgtagcatcctaacaatagtgacaacacagtacaccccccacatactctcccatgaatcacagaacctcaaatcccaccaaatgccctcctgcaggtttcccatagatttgcacaaggccacagtagccatgctttcccgctcctggtgcccaaaatctccctggctgcttncactgtgggctcctgggaggatcagctgccaccctgctcttcttggcctcctgcccattggcacccctttccgttctgctctggctgtcactggggaaggagcaatgggtgagctttcttccctcatccactggggatcccatcactagactgtaaataactctgcactgcatcctcagattttcaggattttaggagactctgggaatgcagcagttctctttggtctcctctttaccacagccatcaatatgacaccatgatctcatcgccaacctcttcagggctgtcctctaacctaggactgggctgtacatactctagaattag

SEQ ID NO: 1567 - DNA, 661 bp, Homo sapiens
  misc_feature [331]..[331]: Chromosome 15, SNP identification no. = rs1869453
  misc_feature [331]..[331]: allele = a, in linkage disequilibrium with rs2469583, respectively
  misc_feature [331]..[331]: n is a, t, c or g
ccttatcactctgtctccagtcacatacagcctatttagtgtgttgataaccatattaaaatcatccacatacagtttgaatattgatgaaagcacaactatatttagatttgatttttcttccctagtcctcaccctccccaaactctcatctttcctatttctttaagtttctcgaaaattgtgcaaattgttaaacatttatcagaatatgtttttcatatcaagacacatccatacagtaaaggttttggctgagctgatcagcttctctgatcgggagaaattgcttctgtgtaagaactaatacccacctggtttcaaacctcanccgctggcaaatatgtcatagcaagagacatttcctgtttctttgacagattggcccggggctgaaatttaatctagtatgtcaaaagtggtaggtggggagaaaaagcagagaaactctgtccccactcagatttttatagacaaccttttttgaaagtactgtggttatcagtgggacctgataagcagtaacggtccgcattgtaaaataaaacaataaagagcctttatagacctctaaatttattattttcaatgataaaatattcataccaaaagacagatgtggggattcacaggcaaaaaccaaaatgatctagtaacagac

SEQ ID NO: 1568 - DNA, 661 bp, Homo sapiens
  misc_feature [331]..[331]: Chromosome 15, SNP identification no. = rs1426656
  misc_feature [331]..[331]: allele = c, in linkage disequilibrium with rs2469583, respectively
  misc_feature [331]..[331]: n is a, t, c or g
aggtactgcagtgttgcaagacaagacatgcggtgctcctgaggcaggtgcaaaggaggcatggcagggataagtctggggagcaagaggctagatttggaaagatcttttaggccacactaagggatttggccatcactctgcaagaagcctttggaggattttagcagaaaatgaaaatggtgctttctggatggttgtgctggtggttggaggaaagaaatcctgaataggaaagccactagaggaaggcctgtaaggagaccatctcagaaggccagacaaggatggggcagcactgctggttgagaggagaggagtgagttgaganatatggagaaagtgagaatcaataagatgttttcttggggaatggaaagtaagggaaaacaaggagtcgagaatgcaccgaaatgtctggctcaggtggctaaccacatggctgtattgttaactaaaatattgagcatgggggcagaagggtgtggactttgcaagaagatgaaagatgccactctttacatatgtagttgctcaatggatgaattgatgaagtatcaaagagcaatatcttggtgaaatacacttttcatctatagtgtgtcatgtccttatagcaagaacaacgcaatttgcagaatcaatagactccaagggctgt

SEQ ID NO: 1569 - DNA, 661 bp, Homo sapiens
  misc_feature [331]..[331]: Chromosome 15, SNP identification no. = rs17340116
  misc_feature [331]..[331]: allele = g, in linkage disequilibrium with rs2469583, respectively
  misc_feature [331]..[331]: n is a, t, c or g
caaggagtcgagaatgcaccgaaatgtctggctcaggtggctaaccacatggctgtattgttaactaaaatattgagcatgggggcagaagggtgtggactttgcaagaagatgaaagatgccactctttacatatgtagttgctcaatggatgaattgatgaagtatcaaagagcaatatcttggtgaaatacacttttcatctatagtgtgtcatgtccttatagcaagaacaacgcaatttgcagaatcaatagactccaagggctgtacatcattatcttagagctcaacatctccctgctccctactgacaaaagctccagcctcntcttctactgtgggtggcggccataagccccacagcatacatgcttccacttcaggtcagaggatgtgcaggatgtgccggctttctcgctttctcatttctgatatggaaatagtaatgcccatcactccacccacctgctgcccttcttccttgatagccattttgaaaaggtaaattatctaatacactgaccatatcttgtattgcaaaagtaaacatgttaatgtaaacccacctaggagatgaagaacgaagccctccatttcaaatcaggttgcctttggtgacactcattctttcataacttacttcctgctaatagtgcat

SEQ ID NO: 1570 - DNA, 661 bp, Homo sapiens
  misc_feature [331]..[331]: Chromosome 15, SNP identification no. = rs1453857
  misc_feature [331]..[331]: allele = c, in linkage disequilibrium with rs2469583, respectively
  misc_feature [331]..[331]: n is a, t, c or g
tcgaaggaaaccgggaaacacatgacggaccgaaaaagtatagtcaatgaactaaaaatagggaacagacggtacgagaacctcagaaacgacagagtcacacacaaaatctacgaattacggaggagggaacttcgggtaagggagacttgtatacaattattccagggttcttcaccacgatgtaaaacgtcgtgttaaagtcaacgggtctctctatctaccgaactttgtccgtttccctgggggagttcatccgaacctcttgtcctggtggtcctcgagacttaccttaagttagtctaccatgatggcctttccccctatcctnctcactagggaaactgtccttttgtttaactttccctttcttttagcctttcgtttacggtcaaaagttctacccctgaccctcgtctccccgcgacgtaaactagtttagctccgaagtgtgacgttatcaaaagattataagactataaagatagactgtagtctgtcccagaactaatttcacagaggactcctttctttgaaaggaaacatccaaaacccatggtcctaattagagtcgaatctactaccggggtaaaccgaccatttttttttttttcgtatctatcgtccactaatacggaagaagggagaggacagtcgaacg

SEQ ID NO: 1571 - DNA, 661 bp, Homo sapiens
  misc_feature [331]..[331]: Chromosome 15, SNP identification no. = rs1453856
  misc_feature [331]..[331]: allele = c, in linkage disequilibrium with rs2469583, respectively
  misc_feature [331]..[331]: n is a, t, c or g
cttagattctacggtccttcgtatctttgagagactgtagagacataaagtcctggatagaaacgatccgtccttctttacactatagttgtgttttttatatttaacttttcgaaggaaaccgggaaacacatgacggaccgaaaaagtatagtcaatgaactaaaaatagggaacagacggtacgagaacctcagaaacgacagagtcacacacaaaatctacgaattacggaggagggaacttcgggtaagggagacttgtatacaattattccagggttcttcaccacgatgtaaaacgtcgtgttaaagtcaacgggtctctctanctaccgaactttgtccgtttccctgggggagttcatccgaacctcttgtcctggtggtcctcgagacttaccttaagttagtctaccatgatggcctttccccctatccttctcactagggaaactgtccttttgtttaactttccctttcttttagcctttcgtttacggtcaaaagttctacccctgaccctcgtctccccgcgacgtaaactagtttagctccgaagtgtgacgttatcaaaagattataagactataaagatagactgtagtctgtcccagaactaatttcacagaggactcctttctttgaaaggaaacatccaa

SEQ ID NO: 1572 - DNA, 661 bp, Homo sapiens
  misc_feature [331]..[331]: Chromosome 15, SNP identification no. = rs12324567
  misc_feature [331]..[331]: allele = c, in linkage disequilibrium with rs2469583, respectively
  misc_feature [331]..[331]: n is a, t, c or g
ggaatgggcttcaagggaggaggcattaagcatctaaaacacacactgagacagcaaagactccaagagcatggcagacaagggataaaaatcaagtaactgatatgaaaaagccaggcagtacacaaagggccaaaggaagcttttcaatttatattttttgtgttgatatcacatttcttcctgcctagcaaagataggtcctgaaatacagagatgtcagagagtttctatgcttcctggcatcttagattcacctgaactgaagccagaaataatatcataaaactaatttagccatcacaccaataggactccccagccatgaganagactggataattacatgtttcctataatttctgacacttgactagtttcagcaaatggcacttctaaatatacatctctttgttgcagctacctctctacatcagtttttcatcaagcaaaagaaattgaacaaaaagttaattgcaaagatgaaaaatccaagtcattgtatcagaacaatctaaattaattgactccccctgccccctgcctccaaaagtccaataacctaagtgatcgggaagacaagctgatcaagccacaggtttgtaaagtccagacgagttgtaccatctcaggggagttgcttcacctctgggctctcacc

SEQ ID NO: 1573 - DNA, 661 bp, Homo sapiens
  misc_feature [331]..[331]: Chromosome 15, SNP identification no. = rs748848
  misc_feature [331]..[331]: allele = g, in linkage disequilibrium with rs2469583, respectively
  misc_feature [331]..[331]: n is a, t, c or g
aggacgggtctccacttcatgtaaaaaaagagaggaactttcaaccaaccagaaatactaacagagttattcatcttacaacaccttcactaccacgtactgaagagtccaatatagttattttccagtgtaaaacagatcgggaaagagagagaaatccttataagtggtaattctgggtcgacggtacaacactccttcgagtacggtgtacctctccggtgcacacctagacccgttgtcgagaccgactccagggtcgattgattgtgggtcatgactaccggtttggaaggtttctacggtcgaaggttagagtacggatcccccngtgtctattcaactgggacggttcagaccggggtcaacgtctcggtactcgttttagttacaacaacatgattctatgattcaaaatcccaccacacaatacatcgttatattcgttttatggttcaaatatgtcaaccaatcatttactaagtcctaaacttgaattctagacatattgacaggtgaagagaaccgaccaaggttctcttggaataaggttctcttaggaataagagggttcggaatgaggaaaggaagtcggaccttaagtctccgtaagacggagaggaacgacatccacacgaataacgataagtcggggattaag

SEQ ID NO: 1574 - DNA, 661 bp, Homo sapiens
  misc_feature [331]..[331]: Chromosome 15, SNP identification no. = rs930016
  misc_feature [331]..[331]: allele = t, in linkage disequilibrium with rs2469583, respectively
  misc_feature [331]..[331]: n is a, t, c or g
acttggtattttgcttatattgctacataacacaccaccctaaaacttagtatcttagtacaacaacattgattttgctcatggctctgcaactggggccagacttggcagggtcaacttatctgtgcccccctaggcatgagattggaagctggcatctttggaaggtttggccatcagtactgggtgttagttagctgggacctcagccagagctgttgcccagatccacacgtggcctctccatgtggcatgagcttcctcacaacatggcagctgggtcttaatggtgaatattcctaaagagagagaaagggctagacaaaatgtnaccttttattgatataacctgagaagtcatgcaccatcacttccacaacattctacttattgagacaatcataaagaccaaccaactttcaaggagagaaaaaaatgtacttcacctctgggcaggagagtatccaagttcaggatgtgcctatgctgctgggaacattgctgtggtcatattttgaagctaccatctgccatacttggttaaattactgaggcttctaagcctcagtttctttgcctgaagaactaggataataaaactttatggcgtttgtacaaaggttagagataatgtatgtcatgagcttgcactgagtaggtg

SEQ ID NO: 1575 - DNA, 661 bp, Homo sapiens
  misc_feature [331]..[331]: Chromosome 15, SNP identification no. = rs930017
  misc_feature [331]..[331]: allele = t, in linkage disequilibrium with rs2469583, respectively
  misc_feature [331]..[331]: n is a, t, c or g
aagggctagacaaaatgtgaccttttattgatataacctgagaagtcatgcaccatcacttccacaacattctacttattgagacaatcataaagaccaaccaactttcaaggagagaaaaaaatgtacttcacctctgggcaggagagtatccaagttcaggatgtgcctatgctgctgggaacattgctgtggtcatattttgaagctaccatctgccatacttggttaaattactgaggcttctaagcctcagtttctttgcctgaagaactaggataataaaactttatggcgtttgtacaaaggttagagataatgtatgtcatgngcttgcactgagtaggtgctcaatagaaagtctcagcccagattgggggtcaggcctgggtaagcagaaatcacctattgctcttgcagtggttgctgaatttctcagtgacacacctgtacctggacaagaaacacaattgtctgaacaagaataaagttaaaggccaaagcactcatcctgcaggcccttcctaactccctttgggacttctcaccaggaccctgtcttagggaggcatcagttcagttagtttctcctacattattgcatattttttaggcaatttaggttggatgtaaacaataagtaactaaaaataatgagtga

SEQ ID NO: 1576 - DNA, 661 bp, Homo sapiens
  misc_feature [331]..[331]: Chromosome 15, SNP identification no. = rs1453855
  misc_feature [331]..[331]: allele = a, in linkage disequilibrium with rs2469583, respectively
  misc_feature [331]..[331]: n is a, t, c or g
gtcctagaaagaactttaaaggtaagtcaaaatggtaaaatacatccaatcggaaggattcagagtaacattttactagtataattgtaaagtaactttcacctttacttttatcacgggtgtcgtaaaatcaggaacaactttcctgattttactactccctacatactactacattcctcgtggactatatcattctcaatttttttattattaacgattacgtcaccacttcctgcctctattcctatcggcactgctcagtgactttctctgttccagtagtcaaaagaacaggtagagagtccaacggtacttctaatttactaangtaaaaacatctcaaatcgtctcatggaccgtgtatcattcgtgataatttttcacaattaaaagtttgattatcataaacttattcaaagggtgtgagacgttatatctagtccgaagacaacgtactcccgttgtcttttccttccacaaacgagggtgcctgtgtgaaagatccgtcagtaaatcaaaatactagttctttcttgttacgtaaaggaggacctatacgacaacagagatttctgttgtccacgagacggtgtcacgactgatggtttattaaacaggaaaagtggaaaggagtacgagtgcgaagaaaacatgagaa

SEQ ID NO: 1577 - DNA, 661 bp, Homo sapiens
  misc_feature [331]..[331]: Chromosome 15, SNP identification no. = rs1025199
  misc_feature [331]..[331]: allele = a, in linkage disequilibrium with rs2469583, respectively
  misc_feature [331]..[331]: n is a, t, c or g
aggacagccggacacctggggagatggacgggaccatagggaccatagggataatatctcagccaaggcgatttgcttcctttttgcaccaaattctgttcctgtcatgccaaggaatctcagtctaaggccttcgagacctgcattttaaaaacctaaaaacctgaaaggcttcctctcccacttgggctctcaatctttcctgaatacaaaagactgaaaaaaagtaaagatcttgaaaaacagtcccaaaccatttcctgcagcctaattcattctgatccacacctactcaaattacattggtggctttgttctctggctgctttanttactaaatgacacagcaagctctctaggtagagggaacaaacatacacagaggagccatgcacaaaaataaaccaggttgaaaccaaaaaatgaaccaaactcaaacatattttacagacatttaaaatgccaaggccagaatggcttctaaaaagccttcagaattaaaaaatctactcaaaactttgatatcaagtatcacaatttgcattttattatatgagtcatgcatgtttatggtagaaaaataagagaagggttagtttaaaaaaaaaattgttttttacaataccagaagaaacacacaccacacacacacacacacaca

SEQ ID NO: 1578 - DNA, 661 bp, Homo sapiens
  misc_feature [331]..[331]: Chromosome 15, SNP identification no. = rs11070623
  misc_feature [331]..[331]: allele = a, in linkage disequilibrium with rs2469583, respectively
  misc_feature [331]..[331]: n is a, t, c or g
aagttatgttcacacaaaaacctgttcacacgaatgtttatagcagctccatttgtggaatcaacccaactgcctttcaatgggtgaatggataaacaaactgtggtatatctactcagcagtaaaaaggcatgaactattgaaatgcctaacttacatgactctcaaaggcagtatgctgagtaaaagaaaccagtctcaaaaggttatatactctattgttccatttctgtgacattcaggaaaaggcaaaactgtactgatggagaatactgtggtggttgccaatgtctagagatggaggaagtgattgaaagtggaagctttatgnggtgatgaaactgctctgtgtcctgattgtgatggtcattacatgatatatatatttactgtgtgtttagttaaaaaaataaaattaatttttaatgtattcaatttattcaagaaatacttaagtaccttctctctttgagacattaatttggattccagcccttggagtgctgaaaaacaacagacaagagacaagaaaataaataatcccaatacactgtgtttgtctgcatggcaagaagctgtaaaaatacgtggcaggagaacctaactctaccttgagcatggtttgggcagagagtgcaccctagagaaagtgacaggaaaa

SEQ ID NO: 1579 - DNA, 661 bp, Homo sapiens
  misc_feature [331]..[331]: Chromosome 15, SNP identification no. = rs2433363
  misc_feature [331]..[331]: allele = g, in linkage disequilibrium with rs2469583, respectively
  misc_feature [331]..[331]: n is a, t, c or g
taaatttttgtaaagaaagacggtagtggatttgttcttcggttttctactaattttttttactttatacaataatgtaaaggtccaattgatcagacacaaaatgaataaaataataatcatcattattataaagtcgaaaagaatcatagtcaaatatgtacgtccatatttcaaacgaaatactagttaagagaatatacataataatatcgtaataaataagttctataggacgtaccctacctcaaatttttcatttctaagaaattaagaattcataacgttagactttcggtaaccagacttgtcgaaccgttcggacccaganacctgtctcaagtttaccgtccagagggtcgctccggactcttttcccacgtgagattctctaaagaaaagtgacctcagagtcctgcccctccccgcctgaaatctacggtcaccctgtccccacaggacaccgtcggccggtacgtaccgactggagtctccgtaaaaattttaccctgaagtgtgcatagagtgagtcttaacgactcgtcttttttgtctaggtgccgaaaacggagggcaaaatgggaaagtgaaaaccgaaagagaccacttttatattcgagtgtgagactacccgtcctctagtccctactgtgtccggtca

SEQ ID NO: 1580 - DNA, 661 bp, Homo sapiens
  misc_feature [331]..[331]: Chromosome 15, SNP identification no. = rs1426655
  misc_feature [331]..[331]: allele = c, in linkage disequilibrium with rs2469583, respectively
  misc_feature [331]..[331]: n is a, t, c or g
agtcgtgggacagcaccacgtcccttcgggggttccggacctcagtactgaccccttccaggtgacctgaggacgtaccaggaaagacggtcccgtctttctcccgtcccccttccgtgtccactaccacgataggaaatcctgatcagtaattgaaaaactatatctcagataaggaagagactagtagtttcgacaaaacacgtccttgtctacatactgaatgtgaaattagataagaaagtaagtcattcataagtgactcttgtatggaacggaccccggaatctcaccttcacaacctttgttccagttcacttcacctcctctntccggtaccgaatacgtcacggacccgaacccgcccggagtctcttaccgagaatttatcctagtccgttgggagtatattcttttaatttccgacacatctacgataggtatttcatactttcctattcttttagaaggaaccgacttcgtagacccctccagagttccatctctgtcacgacaccaactggaacttcctgtgcacccgggacactggtctgtcccctccattcctgactcgtcactctgtcagtctcgtctccatccctctacccttcgaagaccgtacaagtccttcacttgttacaagacaaaccgattctggacc

SEQ ID NO: 1581 - DNA, 661 bp, Homo sapiens
  misc_feature [331]..[331]: Chromosome 15, SNP identification no. = rs2469583
  misc_feature [331]..[331]: allele = t, c
  misc_feature [331]..[331]: n is a, t, c or g
aaccgggtcgagggggcttaccgagacaacggtgaaacgagagaggtggtagtgacgggtgtgtcctacacccaggggaggggtgacggaaacaagtccctaactttgtcagggtgtattggtgggagaaatcagaccgacagggttggtccggaggacccgtgtccggaggtgaactccgtggcgacgggagtggtgactatcctctctcaagacactcagacctgagtgtctacgggacaccactgtgtctctagtctctgtttcgaaccccggtctcggatcggggtttaccgtctggagggacctctgtgtccttgaccggttcacngtctgtaaggaccacaaagagtaacgacacaaacggtgggggacccctagtggtgtacgtgacaatcgtctaggacagaaggagggactgcaggaatggaacgagacaggagacaatgttgtttcccactcccactttccgaccgtcaccaacgtcccctcctacgtaacactgaaaacctcacactataagtcgtgggacagcaccacgtcccttcgggggttccggacctcagtactgaccccttccaggtgacctgaggacgtaccaggaaagacggtcccgtctttctcccgtcccccttccgtgtccactaccacgataggaaat

SEQ ID NO: 1582 - DNA, 661 bp, Homo sapiens
  misc_feature [331]..[331]: Chromosome 15, SNP identification no. = rs2469581
  misc_feature [331]..[331]: allele = c, in linkage disequilibrium with rs2469583, respectively
  misc_feature [331]..[331]: n is a, t, c or g
tccaatgggaatttctaagacccactacctcataacgtagacttgtgaccctgttgaggtcggtttaacgttcaaaacaaaaatcctcgagaacttgttcagactggacccaatggttttgaccaaactcttctctgaagtgtcggaggggtagagggttcctcgaactccgtaaaccgacttctaaacccttgaagctttctagcaaagtagttgatggttttatttgattagttttattgagaaatttcgatggatttcaagtaagaccttgttctgttcaaatatttatgccttttattaattcttttccttaacaaaaaatcatcanccccccggtacccctcttatttttaaaagatgttctaagtggaaacggtattgttcttaaatagaacatcccgaaacaggtaaagtaagacaggacaaccgactaatacacatgtaacagaagagttttccctcttaagactaacggaaaaagggaaaaggaaaaggaggaaacttcgcccctccgtttgttggttctgtgcttccttgtttcggtttgtgatgttttgtaattatcttataagtgaggtttactctaaaaatttctccgtgaaatttacgtcgtttctggattcgtggttatagttacaaggacattcgtcttttattt

SEQ ID NO: 1583 - DNA, 661 bp, Homo sapiens
  misc_feature [331]..[331]: Chromosome 15, SNP identification no. = rs6496053
  misc_feature [331]..[331]: allele = c, in linkage disequilibrium with rs4372639, respectively
  misc_feature [331]..[331]: n is a, t, c or g
ggaagagtcccttctccttaattttttggaattgttaccagttctcttttctatgtgtggtagaattcggctgtgaatccatctgatccagggaaattttttgaccggtaggatttttattactgactcaatttcagaaattgatgtttgtctatccagggtttaaatttttttaaattcaaacttgagagactgtgtgtttccaggattttacccatttcctctagatttgctaatgtctgtgtatagaattgttcatagtattctttgagaatcttttttatttctctgggaacaaccataatatcatctttgctatttctgattgtanttatgtgcatcttttctttttctttgttaatctagctagcagtctatcaatcttgtttatttttttcaaaggactaactcttggtttcattgatcttttgtatggatttttgcatctcaattctgttcacttctttgctaattttagttatttcttttattctgctagctttgaggtgttttcctttttttagttattttatctacaattttagattgttaattttagatctttctaacttcttgatgaagttagggctataagatgtttagggctataaaattttctcttaacaatgcattagctgcatttgagattgcagtaaaatgt

SEQ ID NO: 1584 - DNA, 661 bp, Homo sapiens
  misc_feature [331]..[331]: Chromosome 15, SNP identification no. = rs12439498
  misc_feature [331]..[331]: allele = t, in linkage disequilibrium with rs4372639, respectively
  misc_feature [331]..[331]: n is a, t, c or g
tatccttgccatactatgtacattttcttccttgaggagaaatctcctcatctcaactgtattgtgctgagaaatatagagccagaatgctaatgcagaggtgaatgatccatttacaatctgcaccaagtgtgcatgcttttgtgtttgttcatatgcctctgtgtgtgtgtgtgtgtgtgcgcgcgcacatgggtgagcgtgtgtgtgttgatgggatggggggttatgcttccatccctttatttaggacagttcttttctcaggtgaaaatatactgagtggatagaaatctcctctcattatttctgtgtatcattgctcttctgnctcagaggctcatctagggatagaactgttgttgaccaatattcttctttgaactctgcatctacttttgtatgtttttgaatacagcagtaggaaagtgaagttggaaaaacaaaagttcatagttttctgctttcatactcctaatttgagctcactaggtttttgttttgtttttcactaaatctgaattaaacagaatcgctaggtttttcttattgtttcacaagacctgtacagcattagagttaaacacaatcaccaacattaacttattacccagtgaaaacgtttctgtgtttaacattccagatagacatcaccaagtcc

SEQ ID NO: 1585 - DNA, 661 bp, Homo sapiens
  misc_feature [331]..[331]: Chromosome 15, SNP identification no. = rs4984579
  misc_feature [331]..[331]: allele = a, in linkage disequilibrium with rs4372639, respectively
  misc_feature [331]..[331]: n is a, t, c or g
ttgtctttgtcataacactagtcatcttctgcagtgttatttgttcatttatttatttacttattgcatgtcttttcccactacaatataagtttctgagggcaaaccctttgttttcttgctcactgctctttacttggtaccaaaaagagtgtctggtacatagtaggtgtcttaataaatatctgtgccaaaatgactattaatacaagtaataatactataaaacatctttctcagaaatattacacgaattatgcaaacataaatttgctcattgaagcaaaattaaaacttttgtcaaattcgccccttatatcccaatgaaatntgacagatttaaatgtagaacatatttttatgtaggttataagctctcacaggctgcccttttatatttgttataggaaatagcctattatgagtgttgaattaatatggatcatgattgatttaaaatgcatggtgttttgtgctggtattcagccaacatctatattcaattaaataatcattacagttgccagcagttgtgcattacactaatggcaagagatacacttgcaggggctgaattttattctgggatgatataggtgccatcccaagtctgagagagatgctgaaatgtgaaattctgatctcataaattagtatgtgc

SEQ ID NO: 1586 - DNA, 661 bp, Homo sapiens
  misc_feature [331]..[331]: Chromosome 15, SNP identification no. = rs4489958
  misc_feature [331]..[331]: allele = c, in linkage disequilibrium with rs4372639, respectively
  misc_feature [331]..[331]: n is a, t, c or g
acaggaggcattgttttgggagaacagcagtcagatctctctcagatgcctacctaagcatccccagtaagagggagccattgtccggggttctatttgcatgaccagttggagtttgatggtctgaaggtgagaagaggcaaactgggttattagaagacatggatcaaaaagaaataagggggtaaaggacagctcaaaaatcctaagcctgctgacacacctatctggggctgtagttatgcctggtaagacttgggtgcatggggcttggctttggttagctcccttggtcttattttcccagaaaagaagcctctgggttatgggnaccccatttatccccatcaactggcatgatttgcaggataattgcccagatttagggttttgatccagatttttacgttacccatcctttctgtttcttctgagctgcagccatagatcactggttggatcacaggaattagcagtgttagtctaaaatgcaaaaaaaaaaaaaaaaaaaaaaaaaaccagaaaaacaactaataagattagaattcaatgacaagtgtatgataagttttaaagcataatttttgcttttctagttcttatttttaagcaaatcatggtagaactgagttgtttgcaaaataaactttagacttatact

SEQ ID NO: 1587 - DNA, 661 bp, Homo sapiens
  misc_feature [331]..[331]: Chromosome 15, SNP identification no. = rs6416529
  misc_feature [331]..[331]: allele = c, in linkage disequilibrium with rs4372639, respectively
  misc_feature [331]..[331]: n is a, t, c or g
ctctaatggaattctattccataaggaatctcagataagactttttgaagctgagcctagccgtggtcttgtacccttagatacctatgagttgggtgcacttttctcttcttaaggtcccaagataacttggggatcctggacctattagaaagtgacattctttactcaccacaggttaggaaccctgtacaaggactgcagacaaggtatgaggtcagttttcccaaggggcttttattggctctacaagtcaagcttgatttcttaaagggaagtatacccttccagtcaaagccttgataaaacaaccagtttctccagttgagtnctgttgcaaaagaaaatggattcttatttcatgtatgcaaataactatattgccataagttaagaatactcacaaatagtttccaaattcttgagaaaccaggcagagagaaacaaacatgctccaaattttgttcacaggagtatactttaccgaactcttaaaagctgtaaattgctaaaaataagtttttctgactctgaaaaacaaaacaaaggatcagcaatgtattaagccaaatcaaaaagattacttcagtcttcgattcagtccattcagttaactcttctgcttgatattcatgaacatttcagctcttcataagtcctg

SEQ ID NO: 1588 - DNA, 661 bp, Homo sapiens
  misc_feature [331]..[331]: Chromosome 15, SNP identification no. = rs4247091
  misc_feature [331]..[331]: allele = g, in linkage disequilibrium with rs4372639, respectively
  misc_feature [331]..[331]: n is a, t, c or g
gtaatgacacaggatgttttcgggtgccacttcaccaaccagtaatttccatggcctgtggtgttccagcctgggcttcgctatgctccaggctcactgctggacttggcctgcccacgtggcctggcagggtgcgctcagctcacactaccagtctggataccatgctcacttcaggatccacacccagcccatggctggcctaggcatgctgtgacctgcttctgccttgggcactggagacgacagcaaccacaaaaccccaaagtgggtacagcatgtcacagctcttgcttggggaaccccgaggtctgggcctccagaagggtcncagctcatttgtgttacagttcatttgttcccatggtctgcacacttcagcgaatgggggtgtgtcccagcttgttcagtctgccacccagctctggcccacagctcctggacaggccctgccctgctgccactttctgtcacgtggggcagctgcttggcgctggtggagggtaggagggctacagtggtacagctactttccatctgccagtgggttccgagttcttgtcctgcatccaagaagaatgaggttatatggacaaccagagtgtgagcaagttggagaaatgtttcattgagtgatggaacagctttcagtgaaggggga

SEQ ID NO: 1589 - DNA, 661 bp, Homo sapiens
  misc_feature [331]..[331]: Chromosome 15, SNP identification no. = rs6496059
  misc_feature [331]..[331]: allele = g, in linkage disequilibrium with rs4372639, respectively
  misc_feature [331]..[331]: n is a, t, c or g
ctcctctaaattttaaattcagaatgtcagagttcaagaaaatccctttttgaattttaaaggcaattgcatgacatccataaatcaagttgcataaaatggacacctttgtgaaatatccagttttataatttgcatccagtttttatgtatttataaatataataatttagattatataataatccatattagaatgattataattttatgatttgcattcagacataatttttttccataagacttgcacatcttttgttagatttattgtaggtgcttatcctatattgctatagtaataatatatacttaaaattctattttctgnccatgcatggtggctcatacttgtgatcccagcactttagaaggccagtgcaggatgatcgcttgagcccagaagttcgagaccagcttgagcaacatagtgaagcccctatttttacaataagtaaaaaacaaaattcgatgggtgaggtggcatgtccctgtagtttcagttacacaggaggctgcggtgggagaattccttgagcccaggaggtagaggctgcagtgagccatgattgtgccactgcactcaagcctaggcagtagactgagaccccatcttaaaaaagaccaaattctgcttcccaactgttgccagtatagagct

SEQ ID NO: 1590 - DNA, 661 bp, Homo sapiens
  misc_feature [331]..[331]: Chromosome 15, SNP identification no. = rs6496060
  misc_feature [331]..[331]: allele = t, in linkage disequilibrium with rs4372639, respectively
  misc_feature [331]..[331]: n is a, t, c or g
gccctgttccagcaaagctggacttaactccatctgactgtcagcctctctggtactctgcatattcctatctctagagtctctgttgactccattaattctggaatatctctggggtcacaccaatctcctgcctagcctacacacacattcctttctatccctgacaagtgagaaaaaagaacagatcctagaaaatgtcttcattttcttggtaggcttatcttttatgtaagtatgataatattatatatattctgatatactatattataagtagagcttataattccactgataagcagagtaaggaaaccctaccacagagtgntgcaaaagaataagcatctgacagcttcagtgagtcagctttctgtgtgatactaacctgagtgacttaagcagccagatttcaaaaagaaatagatttgcctctaattattctaaatgcatctgtttaaattggctataatacagcaaatgtcatgtagctttaatggtacacattaggacatgtaactttatgactggaaataggtatgttattaatttaaaaatccagtttcccatatcccctttgatacagtaatgggctcttggagtgagagactcatattccaaaagatccacgtgcaatccaactacaggttagaaatcaaat

SEQ ID NO: 1591 - DNA, 661 bp, Homo sapiens
  misc_feature [331]..[331]: Chromosome 15, SNP identification no. = rs6496061
  misc_feature [331]..[331]: allele = c, in linkage disequilibrium with rs4372639, respectively
  misc_feature [331]..[331]: n is a, t, c or g
aatggtacacattaggacatgtaactttatgactggaaataggtatgttattaatttaaaaatccagtttcccatatcccctttgatacagtaatgggctcttggagtgagagactcatattccaaaagatccacgtgcaatccaactacaggttagaaatcaaataatacgcagccactttcatttttcaaaaatctcaaacagggcatatataggttgttactttatgatgacttgctaagatgcattgtttataattctttagtttctgttttcagatttcagtgtcttcctttgccaagtttcaaaaggaaaaaaataaattaatcntctggagctgaaacagaaacatttggtctcctgtaatcctcagttcttaacctaatgtggcagctcatagggaaactgtcagatctgcaatcctaattgctataagttgcctcccatgtgtacacatgtaatggtcaggagtgaatatgcgttgacaacttatcttctctgttccatagttctaaacatccttagtgtgtgtgcggttttacctctgtgactcttgggtaggctacatatgggtgtgtaaagtagctgttgccagcctggaagctagcctcttctgagaacattcctactcatatagagacaaacatgagaaactatggc

SEQ ID NO: 1592 - DNA, 661 bp, Homo sapiens
  misc_feature [331]..[331]: Chromosome 15, SNP identification no. = rs4372639
  misc_feature [331]..[331]: allele = a, c
  misc_feature [331]..[331]: n is a, t, c or g
aaggattgggactttgtgctaatttcacctttgaaaaactttgatttagaggtcagtgatgtgatttttcattttctaatgaaaggttgatcctttattgacaatagtaaagttagtaggtctcctgtataacatgataaagtactaataagccagccggtctggaagtttttagaatcagatggggagagcagtccttaccccattgtccctgccatttgttctcaagcccctcccttagtttttacagtcaacccttgcagaaagtaaatgttcatcatcaggccctcttaatctgtttcaataaaattgttcaagtaacagaagaaancgaatctgttctctagaaggcaggaaggcagggagggtgtggtatgtgctgcgcctaccaggagagcaacatttctttgaagtgttatgtagtattttaacacattcctgcatttttaaaattcaactttattacaaatatgtacacttttacattacataattctcctccttctaactaaaggaatttgagaatttgccttttttttttttttttttgagacagagtctgactctgtcacccaggctggagtgtggagtgcagtggcgcgatctcggctcactgcaagctccacctcccgggttcatgccattctcctgcctcagcctc

SEQ ID NO: 1593 - DNA, 661 bp, Homo sapiens
  misc_feature [331]..[331]: Chromosome 15, SNP identification no. = rs766233
  misc_feature [331]..[331]: allele = g, in linkage disequilibrium with rs4372639, respectively
  misc_feature [331]..[331]: n is a, t, c or g
aaaagttctgagaacattccgtaatggtttacttccgttgtatataggttcaagtggaacacttagtttgttaggtaaatatctaaggacactgttagtgtccaagacgaccaataaaaaatttgttttcggtttggttctcgcttatagtccgaatttcaaattcgacagtgactttacttgattcaaactaatttatgtgaaatcgatttacgtgtttctttctttacgcaaagactgtggagagagaggtgtcggttgtggtaatgattatgcgtgtaggagattcggtcaccaaaagtgtgacccgaaccacctctgggtctaaaangtgtgaatcaaaagtctacgacgggactcttcatcctctgtttggttcggttcccccgtaggattaaggaaggggaacgaattggttgtcgaggtaacaacggaataaaataaccaccccttttccatcttaagacctcttaaaaagaaactattttttacttaaaatgtcagttagttttttctttagttccggatgagaagagacgacactgtaagtaaggtttgttgtactatattattgttgttttgtcgaattatgtgaatgtgtatcgaccttcaaatgtagatcctctctggaagctttattatatcaggacaggacaataag

SEQ ID NO: 1594 - DNA, 661 bp, Homo sapiens
  misc_feature [331]..[331]: Chromosome 15, SNP identification no. = rs12440481
  misc_feature [331]..[331]: allele = t, in linkage disequilibrium with rs4372639, respectively
  misc_feature [331]..[331]: n is a, t, c or g
gttgctgaagacagcaattgttactataacattggacataatactttcatatatttttttctcttttaaggatcctaattcatgtttacatatgcggcttgccccgttactcattttagattcccttctatactaagataattttttatcttaatgcccattttgacagtgaagggttaaaaagtcctgattaagttgtaaatggttgacatttagctatcaagtataaatctgtggttaaaacattcgtgcaaatgagtttcagtgtctgtttttcaacaggagcacccctggtagctctccatccctcccctttttctatcttagcacntcattataaaaggggacaaattgcagtactttttcttctccctctgttccaagcccactgagaattaagctttcagaagaggttctcattttgatgctaaacggccctgatattttgcctgacaaattaaaggtggaattatacagaagtgagtggcttatccatgaagtgtttctacctcctgtatgtgtggccggtggctggaaggctggagaggcagaggcagcgcccctcctgagcccctcttaatttcagcgtctgagtggcagctggaaacaaggcgctgactgtttgcctgctgtccagtcttgcattattaggtaaaataaa

SEQ ID NO: 1595 - DNA, 661 bp, Homo sapiens
  misc_feature [331]..[331]: Chromosome 15, SNP identification no. = rs4306453
  misc_feature [331]..[331]: allele = c, in linkage disequilibrium with rs4372639, respectively
  misc_feature [331]..[331]: n is a, t, c or g
tgaggaccagtttttaattatttaggagatctgtgagttggttgttaaaccagccatggtgaaaatatttacagcacagaaattggcaaatgctacaagtcaggccttttatttattatagtattaatttattctcctttttccaacaggctgatttgctatcacaccactgcctaaagtataccatctggaagaaatctgagattttagggatgagaaactagttgtttatccctgatacagcaacttatctagaaattctttcaaatgctgtctgctcagcttaagagacgagtgaatctctttgatcgcatgactgaccctaggttgnatatagttgtcacatgtcagtagcctatgtgatcccaagcacggctccccagctggctgccagcttgcaatatccctccagttttcctatctaccaggttaattgctccccaatcaaaattaaagatgcactaagttcttgcattgagaaaaggacatcacccaattacatttccctattgtcaattctgtgctatgcataacagacttgaaattgaactgtgctcatggaattgagtacaaaagaggattcaatttaacaaacagttgtcgagtacctattatgtatggcataatgaatacaaataaaatagttttaaaatctccaaca

SEQ ID NO: 1596 - DNA, 661 bp, Homo sapiens
  misc_feature [331]..[331]: Chromosome 15, SNP identification no. = rs4247087
  misc_feature [331]..[331]: allele = g, in linkage disequilibrium with rs4372639, respectively
  misc_feature [331]..[331]: n is a, t, c or g
aaaggatcataacaaaatgcactgctattgtgggtctgactgggttatatgccaggtattgtcctggttaagtggccattgctcaagcctgactactgcctatagggtgagttgctgtgagattttaattcacgagagggaggttgtgggtaggagtgatgcagttcccgcgcaaggaagtttgattgcattcattcaatccccacagcctgaaaaatacttcctatttattttattcagaagcttgttgtaacatatcccagagttgcctagtcatttttttccactagtgaaaagtctaatttctttttccattttttattcttctatncaattgactcaattgcaataagggtgtaacattctgctatatttgcctctctcttatctggtttcatcaccaatgcttgttttatcccagagaatggccaataaaagagttaattccattggggtgcctacctgattcatgtttgttcttgattgttcaaccactacttaaacagtaaaataataataataataataataataaattaatttacaaatggtttgtaatgaatctgaggtacctcagttgtcaatttaccagtatatgtcaagtacagggggcacattttccaaagctgtgctttactgcttgacttttctttaagtcagt

SEQ ID NO: 1597 - DNA, 661 bp, Homo sapiens
  misc_feature [331]..[331]: Chromosome 15, SNP identification no. = rs1562628
  misc_feature [331]..[331]: allele = a, in linkage disequilibrium with rs4372639, respectively
  misc_feature [331]..[331]: n is a, t, c or g
tacgaaggacaattcggagactttgacactcagttaatttggagaaaagaagtatttaatgggtcagagtccaccaagaaatatcgtcacactcttacctgaatatgtcatccttacgtacacttacacggtatgtgtatacgactgtatgtaccaatatgtgtgtaaatttttaagttgtacaaaaaaatggttacatactttgtttgtgtatattgttttatttcggaaattacttactatagacttgatgtcaaatagttaaaccaaagtcgattgacggttttatctcttattaaaaataattaattggaattaagagtaagtcttngactgaatttcttttcagttcgtcatttcgtgtcgaaaccttttacacgggggacatgaactgtatatgaccatttaactgttgactccatggagtctaagtaatgtttggtaaacatttaattaaataataataataataataataataaaatgacaaattcatcaccaacttgttagttcttgtttgtacttagtccatccgtggggttaccttaattgagaaaataaccggtaagagaccctattttgttcgtaaccactactttggtctattctctctccgtttatatcgtcttacaatgtgggaataacgttaactcagttaaca

SEQ ID NO: 1598 - DNA, 661 bp, Homo sapiens
  misc_feature [331]..[331]: Chromosome 15, SNP identification no. = rs6496067
  misc_feature [331]..[331]: allele = g, in linkage disequilibrium with rs4372639, respectively
  misc_feature [331]..[331]: n is a, t, c or g
ctcctcatagatccaagaggacctgcttaatgccctcagcactggcaagtgaccacatgtatgtggtgctaaccaaggaagcttacttgagctttgctatccaaggtttttattgagggtcaatcatgtaggcatggaatgccctcaggactgacctcagctactcagactccagtcccaccatagagttcaccataagaaatgttagaataaataaaaataggtgttttctgaaggtcacattgttaggataaatttatctagtcaaactgatacagcacagtccaaagcctgaggcatacgaaaacagacattcgatataaaaacagcnacaacgacctcagggatgtaaactactcttatcaggcagaatattccaagggctcagagcttatctttcataagccactggctacgagccattcctgaaaataggcgtttttctgggatgtccagtgttcgagcaacccaggcctcctgagttaaccctttcctgtctaacaggtgttactcaaaattaagttcccttggacaaatactcaggacgcactgaaataaaaacattaaacagctttctcctttgctcttaacacaccaatagctgtatgacacttcaagtgtgtgagtgtaaatgtttatcttcacttaatggatttcaaaa

SEQ ID NO: 1599 - DNA, 661 bp, Homo sapiens
  misc_feature [331]..[331]: Chromosome 15, SNP identification no. = rs6496068
  misc_feature [331]..[331]: allele = a, in linkage disequilibrium with rs4372639, respectively
  misc_feature [331]..[331]: n is a, t, c or g
ggacctgcttaatgccctcagcactggcaagtgaccacatgtatgtggtgctaaccaaggaagcttacttgagctttgctatccaaggtttttattgagggtcaatcatgtaggcatggaatgccctcaggactgacctcagctactcagactccagtcccaccatagagttcaccataagaaatgttagaataaataaaaataggtgttttctgaaggtcacattgttaggataaatttatctagtcaaactgatacagcacagtccaaagcctgaggcatacgaaaacagacattcgatataaaaacagcaacaacgacctcagggatntaaactactcttatcaggcagaatattccaagggctcagagcttatctttcataagccactggctacgagccattcctgaaaataggcgtttttctgggatgtccagtgttcgagcaacccaggcctcctgagttaaccctttcctgtctaacaggtgttactcaaaattaagttcccttggacaaatactcaggacgcactgaaataaaaacattaaacagctttctcctttgctcttaacacaccaatagctgtatgacacttcaagtgtgtgagtgtaaatgtttatcttcacttaatggatttcaaaatctttccccccggagatc

SEQ ID NO: 1600 - DNA, 661 bp, Homo sapiens
  misc_feature [331]..[331]: Chromosome 15, SNP identification no. = rs11630913
  misc_feature [331]..[331]: allele = c, in linkage disequilibrium with rs4372639, respectively
  misc_feature [331]..[331]: n is a, t, c or g
aaggaaaaagtattcaactatcaaaagtatagcaaaatgtccttaagacatcagttgatgttaactgacttataaataaaaatgacctccttgtttctgaaaaatgtttcccatatgataactcacagattatatttgaaattgcccatatacctgctagaattgactgaacttactactgggcaattaaaattctttttattgtagttgttactattactcttattctgtgaatttgcagcagagttacaaatgagaaaaaagggtaatgtaaaaagcaattggaaattagcaggcagtcatttgaaaatttggtttaaaaaaatcttanggtctcattaatgcaacgtggtaaaaacactctctcaagcattttgtttcaaatacaatcgtgaaatgaacacatggattttgcagagacaaaaggaaagtgaaatcaagccaactttttcacaggaagatgtcttagggtccaagcattatgaatcatttatttagttctgaaatctaataaaacatctttattaaaatgaaagcatgtttcactaccagagatatttttgatctgatagcaaacaagttttcttttatttatttagcatatgcatcacatatgcttttgaagtaaacatcaacgcataacaaataaatactatacaac

SEQ ID NO: 1601 - DNA, 661 bp, Homo sapiens
  misc_feature [331]..[331]: Chromosome 15, SNP identification no. = rs4283178
  misc_feature [331]..[331]: allele = c, in linkage disequilibrium with rs4372639, respectively
  misc_feature [331]..[331]: n is a, t, c or g
gggaggaagaggagaaggggagatggaaagagagggagagattctttcttatagcaaaaatagtcttcatctgtggacaaaattgggtttttgaagctttttctgtgatgtcaaacagcaacatgtgtgacttacattgcttttgcatacaggatcaacgtccaagaggctttggggccagccccatgatgccaaaggtaatgtaatatgctgtaggcagtcagatctcaacctggggatgcttctttgcaaagaataaggtgaaatttcttgagggagtcaggagaatatgagaaggttaaggtgttgctcaaataaaaatgatgctttnagtgactatccaattacagtctacggcagctcttaaccataactatagccatagttggatgaaaacaaaacaggtagattcataggataaacagacatatagaaatgtcctaataatacagaccctaatctacagctgtcttattgccatgatgttcccattattttttagagaaattgcaaatattttttaaaggaccaagaaaaaaaaaagagtttgctttggtgctgttttgaaattatttgcctgttacaatttaatcaagttctgctctggtcctttgtggccaggcaatcaatgggttaagttagatcactaacgagtgttccc

SEQ ID NO: 1602 - DNA, 661 bp, Homo sapiens
  misc_feature [331]..[331]: Chromosome 15, SNP identification no. = rs9920787
  misc_feature [331]..[331]: allele = g, in linkage disequilibrium with rs4372639, respectively
  misc_feature [331]..[331]: n is a, t, c or g
actcctcagtaactctgactggccattgcctgctaataaggattcattatatgtatagatcagtttagcacacattaggaaaatatatcactaacttaacatcttcattatcagagagaatgaaggtttaaaaatatttatttgaatttcatggcaatctatctagctgtgccttctcataagatttcaagatagcatttctatttctctagttacattcaaaatggaagagaaacaagagagaactgaagcagtggctgtagcttttctagagccttctggcccccactcagataatataaaaaatattaagtgccatctcatcagtcanttaatggaagttcttgagggctaaatgagatgtcttgtaagaataggtaatgagcagtagtaagttctaacttagttgtattttattttacttaatttatgtttttgaggcagattctcactctgtcacccatgctggaatgcagaggtggaatcatagctcacttcagcctcaaactcctgggctcaagcaatcctcccacctcagcttttggagtatctgggactacaggcacaggacaccatgctcagctaatttaaataattttttgtagagacgggatcttgctatgttgcctgtatattagtctgttctcacactgctgtagag

SEQ ID NO: 1603 - DNA, 661 bp, Homo sapiens
  misc_feature [331]..[331]: Chromosome 15, SNP identification no. = rs6416531
  misc_feature [331]..[331]: allele = g, in linkage disequilibrium with rs4372639, respectively
  misc_feature [331]..[331]: n is a, t, c or g
ctccacctcagcctggacttcattgtccatatcactatcagcattttggtcaaaatcatttaacaagtctctaggaagttccaaacattcccacatcttcctgtcttcttctgagccctgaaaactgttccaatctctgcctgttacccagttccaaagttgcttccacattttcaggttatcttatggcagtaccccactctctgctctaccaatttcctatattagtctgttatcacactgctataaagatactgcctgagactgggtaatttataaaggaaagaagtttaattggctcacagttccacatggctggggaggcctcagnaaacttgcagttatggcagaaggggaagcaggcacctttttcccgtggtggcaggagagagagagagggaagctctgggaaactgacattataaaaccatcagatcttgagagaactcactcactatcacaagaatggcatgggggaaactgcctccatgatccaatcacctgccaccaggtagattcctccctcaacacctggggattacaattcaaaatgagatttgagtggggacacaaagccaaaccatatcacccaggctggtctcaaactcttagactcaagttatcctcccacccccatttcccaaagtgctgggattgtatg

SEQ ID NO: 1604 - DNA, 661 bp, Homo sapiens
  IGF1R
  misc_feature [331]..[331]: Chromosome 15, SNP identification no. = rs3743262
  misc_feature [331]..[331]: allele = c, t
  misc_feature [331]..[331]: n is a, t, c or g
ctgagagccggggggtgggggtgagagtttgtgtgcccattctgacacttgcagagtagagaaagcaagataatgaggaaggacatccctgtgttattcatgagttcttacctaagggggctcaatagctccttctattccacggttaagattcttctgttactcttactcaagtcatagaaaagacaaaagaggtaaaagtacttaaaagccacatttctctcctccttgcagacctgaaaggaagcggagagatgtcatgcaagtggccaacaccaccatgtccagccgaagcaggaacaccacggccgcagacacctacaacatcacngacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcaggtatggtatgatccagctggccccattgccaccttcctcacaacctagtggagaagatgtgttttatggacacagggtctgacacccagggccatgacccttagacccaggcctgcctgctaaataacgtgcagtcattggca

SEQ ID NO: 1605 - DNA, 661 bp, Homo sapiens
  PCSK6
  misc_feature [331]..[331]: Chromosome 15, SNP identification no. = rs1532364
  misc_feature [331]..[331]: allele = g, in linkage disequilibrium with rs1994967, respectively
  misc_feature [331]..[331]: n is a, t, c or g
tgatggcagtggaggcagccaagtctggagccccccaccaccaatgccaccctgaagcagaagggctgggagggaaggagcattagagagagagagaaggagaactatgtgccaggtcaaaattaaaaagacaaaaaggtgaacagagcaagagagcaaagaaaggatgaataagaagaggggctaggaaatgcctgctgccctctctcgctccctcctgtgctgttcccattatcatacctttttaggccaggaggaagaggcgaggccaaaatatgcttggaaggaatcagaattcagtcaagaagtatacagttatacactgcgaagncttccccttctgcttctgtttctggccactgggcttggtggcagctgttctcatctggtcaccgcgatgtcctagcatcagaaggctatgattgcaaaggtggaatccaggcttcagggcaacaggcctgagctcaagcctctgcgctgcctcttggcagctgtgtgaacccagatgtggcaattcatctctctgttagtctcccctggtgggaaacggccatgatcatgtccagcgcacagaggcacactaagaactggatgcaaagatgactacaagtgcttggcaaccaacagcaatcggcaagaggtgtcaccatctgcaccacag

SEQ ID NO: 1606 - DNA, 661 bp, Homo sapiens
  PCSK6
  misc_feature [331]..[331]: Chromosome 15, SNP identification no. = rs1000914
  misc_feature [331]..[331]: allele = t, in linkage disequilibrium with rs1994967, respectively
  misc_feature [331]..[331]: n is a, t, c or g
attcaaaataaggatccctaggtccgggacccctctccatccgacgcacgagtcagaaggaggacccaacccagagaactcagaaaagtgacaccacgtctaccactgtggagaacggctaacgacaaccaacggttcgtgaacatcagtagaaacgtaggtcaagaatcacacggagacacgcgacctgtactagtaccggcaaagggtggtcccctctgattgtctctctacttaacggtgtagacccaagtgtgtcgacggttctccgtcgcgtctccgaactcgagtccggacaacgggacttcggacctaaggtggaaacgttagnatcggaagactacgatcctgtagcgccactggtctactcttgtcgacggtggttcgggtcaccggtctttgtcttcgtcttccccttcggaagcgtcacatattgacatatgaagaactgacttaagactaaggaaggttcgtataaaaccggagcggagaaggaggaccggatttttccatactattacccttgtcgtgtcctccctcgctctctcccgtcgtccgtaaaggatcggggagaagaataagtaggaaagaaacgagagaacgagacaagtggaaaaacagaaaaattaaaactggaccgtgtatcaagaggaagagagag

SEQ ID NO: 1607 - DNA, 661 bp, Homo sapiens
  PCSK6
  misc_feature [331]..[331]: Chromosome 15, SNP identification no. = rs1108993
  misc_feature [331]..[331]: allele = a, in linkage disequilibrium with rs1994967, respectively
  misc_feature [331]..[331]: n is a, t, c or g
tctggccactgggcttggtggcagctgttctcatctggtcaccgcgatgtcctagcatcagaaggctatgattgcaaaggtggaatccaggcttcagggcaacaggcctgagctcaagcctctgcgctgcctcttggcagctgtgtgaacccagatgtggcaattcatctctctgttagtctcccctggtgggaaacggccatgatcatgtccagcgcacagaggcacactaagaactggatgcaaagatgactacaagtgcttggcaaccaacagcaatcggcaagaggtgtcaccatctgcaccacagtgaaaagactcaagagacccnacccaggaggaagactgagcacgcagcctacctctccccagggcctggatccctaggaataaaacttagaacgaacaaatctgaaccagccttgggaaacaagatcagcacagacgagctgtcttgaggcactgaggaaagacgggaagcagagggcatcaggtagcagcaggaggcggggtcctggcgcgaggacttctgagtggggaacaattccagagctgaggaaggtgccaggctgggcgtgcaaggacaggaggagccccaaacaggcctcggagtaaggagctagggtggcaggtctcagcctccaggctgagtggggacagc

SEQ ID NO: 1608 - DNA, 661 bp, Homo sapiens
  PCSK6
  misc_feature [331]..[331]: Chromosome 15, SNP identification no. = rs880452
  misc_feature [331]..[331]: allele = a, in linkage disequilibrium with rs1994967, respectively
  misc_feature [331]..[331]: n is a, t, c or g
ttttacttattttacagacagtctaccaaggtcgtaggcaaaggaggtacaaccgtagccactaacagacagaaatacgtaaactctagaaggataagcaagaaccttactgtacactataaggaaactttggacatgtaaaaacgtaatacaatactccgatatggactgaagtcggaagacaaagtcgaccgaagagaccgggacaacgacgtctcctgttccccatggtaaagtaataacagtccccatccaacaggtcccgggggtaagtcggaggcgactatgggttcgcacccttcagaggaatagtcacgactcttccccgtcnccaagggtgagggacacacggagggtactggggtgtcacgtccaggggagtaatgacactcgtcgtcactcggaggactgagaggtggtccgtaggactgtgttgaggtcccctacctcccctgtgcaacaatgacgacccacaccaaccttctggtccgagtaccgtaccatagacgaccgtggtacgttcacccggggaaaactccaacgacctccattttcgcgacgaaggatggacgacaaaggactgtacggggtcgtcactccagcccgtggagtaaagcaggagcgtacccacctccagatccgagcggtgagtccgacacga

SEQ ID NO: 1609 - DNA, 661 bp, Homo sapiens
  PCSK6
  misc_feature [331]..[331]: Chromosome 15, SNP identification no. = rs7172235
  misc_feature [331]..[331]: allele = a, in linkage disequilibrium with rs1994967, respectively
  misc_feature [331]..[331]: n is a, t, c or g
acgacagacagaagatggcagaggagtggagctatggtaagtttcttatgttgctcaggtgaaagagttaagtactgattagcgctaaacactgtagagaaacataagtcccaataactgtgtttaaagagtaacagaaaaacagatttagaatgtaaaaatttcaacccattagaatgaaagaaaagagaagaaactacatctaaccagcaaaaggcaggtaaagacagattggtagacagatggacggacagatggatggatggatggatggatgaatagataaaaacaaatacaatagaaataaatccaaagatatctgaaatcagcncatgtatgaatataacaaagtccttctttaaagagactcttcaattgtgttaaaatataaatccagatacatgctgcttataaaaccaacattagaaataaagaatatatgagaagaaggatgataaaataaattcgcaagtgtgctacttttatcaatcaaagtacaggtgttatatcagccaaagtacaattaaagggcaaaaatgagatagagaggattttatattgatgaagattcattataccttgtaatgtaccttgtaaatagctataaaatgtgtacagcgaaaacggaaagaaactgacacatccataatcatcatggaaa

SEQ ID NO: 1610 - DNA, 661 bp, Homo sapiens
  PCSK6
  misc_feature [331]..[331]: Chromosome 15, SNP identification no. = rs12437488
  misc_feature [331]..[331]: allele = t, in linkage disequilibrium with rs1994967, respectively
  misc_feature [331]..[331]: n is a, t, c or g
atgaatagataaaaacaaatacaatagaaataaatccaaagatatctgaaatcagcacatgtatgaatataacaaagtccttctttaaagagactcttcaattgtgttaaaatataaatccagatacatgctgcttataaaaccaacattagaaataaagaatatatgagaagaaggatgataaaataaattcgcaagtgtgctacttttatcaatcaaagtacaggtgttatatcagccaaagtacaattaaagggcaaaaatgagatagagaggattttatattgatgaagattcattataccttgtaatgtaccttgtaaatagctanaaaatgtgtacagcgaaaacggaaagaaactgacacatccataatcatcatggaaaccagcattccttctcagaaacagatcaggtagacaaaaagtaagaaagactccagaacttctgaatgaacttgatagaacacacaggtgatagaggctgatgcctaaaggtatcaggcaggcagggtaaatggctgaagcagccaggtctgtgaaggccacccggggacgggtagactgccctttgagttaggagcaatcgtagccgactgttgccattaaggaatgagggcccagcacagccagagcttctaagctttcatagaaagccccaa

SEQ ID NO: 1611 - DNA, 661 bp, Homo sapiens
  PCSK6
  misc_feature [331]..[331]: Chromosome 15, SNP identification no. = rs12912500
  misc_feature [331]..[331]: allele = g, in linkage disequilibrium with rs1994967, respectively
  misc_feature [331]..[331]: n is a, t, c or g
tttatcaatcaaagtacaggtgttatatcagccaaagtacaattaaagggcaaaaatgagatagagaggattttatattgatgaagattcattataccttgtaatgtaccttgtaaatagctataaaatgtgtacagcgaaaacggaaagaaactgacacatccataatcatcatggaaaccagcattccttctcagaaacagatcaggtagacaaaaagtaagaaagactccagaacttctgaatgaacttgatagaacacacaggtgatagaggctgatgcctaaaggtatcaggcaggcagggtaaatggctgaagcagccaggtctntgaaggccacccggggacgggtagactgccctttgagttaggagcaatcgtagccgactgttgccattaaggaatgagggcccagcacagccagagcttctaagctttcatagaaagccccaaatccatatttttacataaaatactgtgatttgtaaatgtttactcaagttttcaaaaatacacttgtgtgagtcaaacaaaacatgtctgcaggccaaaggcagcttatgggctaccagttgcaatccctaatctgatacagattttttttactcaatgagcatagaataaaaatactcttcaaacactgatatggtttggctgtgt

SEQ ID NO: 1612 - DNA, 661 bp, Homo sapiens
  PCSK6
  misc_feature [331]..[331]: Chromosome 15, SNP identification no. = rs1994967
  misc_feature [331]..[331]: allele = c, t
  misc_feature [331]..[331]: n is a, t, c or g
ccataatcatcatggaaaccagcattccttctcagaaacagatcaggtagacaaaaagtaagaaagactccagaacttctgaatgaacttgatagaacacacaggtgatagaggctgatgcctaaaggtatcaggcaggcagggtaaatggctgaagcagccaggtctgtgaaggccacccggggacgggtagactgccctttgagttaggagcaatcgtagccgactgttgccattaaggaatgagggcccagcacagccagagcttctaagctttcatagaaagccccaaatccatatttttacataaaatactgtgatttgtaaatgnttactcaagttttcaaaaatacacttgtgtgagtcaaacaaaacatgtctgcaggccaaaggcagcttatgggctaccagttgcaatccctaatctgatacagattttttttactcaatgagcatagaataaaaatactcttcaaacactgatatggtttggctgtgtccccacccaaatctcaactagaattgaatctcccagaattcccacatgttgtgggagggactcagggggaggtaattgaatcatgggtgccagtctttcctgtgctatttttgtgatagagagtaagtctcatgagatctgacaggtttatcacgggtttct

SEQ ID NO: 1613 - DNA, 661 bp, Homo sapiens
  PCSK6
  misc_feature [331]..[331]: Chromosome 15, SNP identification no. = rs1994968
  misc_feature [331]..[331]: allele = c, in linkage disequilibrium with rs1994967, respectively
  misc_feature [331]..[331]: n is a, t, c or g
agatcaggtagacaaaaagtaagaaagactccagaacttctgaatgaacttgatagaacacacaggtgatagaggctgatgcctaaaggtatcaggcaggcagggtaaatggctgaagcagccaggtctgtgaaggccacccggggacgggtagactgccctttgagttaggagcaatcgtagccgactgttgccattaaggaatgagggcccagcacagccagagcttctaagctttcatagaaagccccaaatccatatttttacataaaatactgtgatttgtaaatgtttactcaagttttcaaaaatacacttgtgtgagtcaaanaaaacatgtctgcaggccaaaggcagcttatgggctaccagttgcaatccctaatctgatacagattttttttactcaatgagcatagaataaaaatactcttcaaacactgatatggtttggctgtgtccccacccaaatctcaactagaattgaatctcccagaattcccacatgttgtgggagggactcagggggaggtaattgaatcatgggtgccagtctttcctgtgctatttttgtgatagagagtaagtctcatgagatctgacaggtttatcacgggtttctgcttttgcttcctcctcatttttctcttgccaccaccat

SEQ ID NO: 1614 - DNA, 661 bp, Homo sapiens
  PCSK6
  misc_feature [331]..[331]: Chromosome 15, SNP identification no. = rs4965856
  misc_feature [331]..[331]: allele = g, in linkage disequilibrium with rs1994967, respectively
  misc_feature [331]..[331]: n is a, t, c or g
agtagatccactggcagcttgtaccatgtgcctggaaaagctactatattatattatatcctgtgctattctcgtgatagtgaataagtcttatgagatctgatgggtttatcaggggtttctgcttttgcttcctcctcatttttctcttgccaccgccatgttaagaagtgcctttcacctcccaccatgattctgacgcctccccagccatgtggaactataagttcaattaaatttctttttgttcccagtcttgggtatgtctttatcagcagtgtgaaaacggactaatgcaaacacccattggcatattcacaaaaactgaacntgtattaggacacaaagatattctccagaaattccaaaaggcagaaaatatacagaacattctgtgaacccaatataagaaacttaaaaattaacaacaaaaggagcatcagaaaatctacgcagttgaaaaattttataaatctcttctaaataactcctgggttaaagagaaaaatctaagctgaaacgtacaattattcagaaatatatagcaagaaaagcaccatataattaaactagtaagaggtgatgaaaggagaatgtatgattatttatttatttattagaacacataaaatcctgaaaataaagaactaaatacacattc

SEQ ID NO: 1615 - DNA, 661 bp, Homo sapiens
  PCSK6
  misc_feature [331]..[331]: Chromosome 15, SNP identification no. = rs4965857
  misc_feature [331]..[331]: allele = t, in linkage disequilibrium with rs1994967, respectively
  misc_feature [331]..[331]: n is a, t, c or g
tattatatcctgtgctattctcgtgatagtgaataagtcttatgagatctgatgggtttatcaggggtttctgcttttgcttcctcctcatttttctcttgccaccgccatgttaagaagtgcctttcacctcccaccatgattctgacgcctccccagccatgtggaactataagttcaattaaatttctttttgttcccagtcttgggtatgtctttatcagcagtgtgaaaacggactaatgcaaacacccattggcatattcacaaaaactgaacgtgtattaggacacaaagatattctccagaaattccaaaaggcagaaaatanacagaacattctgtgaacccaatataagaaacttaaaaattaacaacaaaaggagcatcagaaaatctacgcagttgaaaaattttataaatctcttctaaataactcctgggttaaagagaaaaatctaagctgaaacgtacaattattcagaaatatatagcaagaaaagcaccatataattaaactagtaagaggtgatgaaaggagaatgtatgattatttatttatttattagaacacataaaatcctgaaaataaagaactaaatacacattccattcaaggaattagaacacagcaacaacaaatttaaaagctgaaggaatt

SEQ ID NO: 1616 - DNA, 661 bp, Homo sapiens
  PCSK6
  misc_feature [331]..[331]: Chromosome 15, SNP identification no. = rs12911482
  misc_feature [331]..[331]: allele = g, in linkage disequilibrium with rs1994967, respectively
  misc_feature [331]..[331]: n is a, t, c or g
gggtatattgtatgacactgaggtgaaaaaacctattttattaaaaatagaaatttttcatcaatcaaggaaaaaagaggagatgtcacaaataagattagaaacaattataactataaacatggaggatgtacttttaaattacgagcatatgatattgaatttatgtcatatatttgaaaatcttgaaaaattgatgattttctaggaagatttaattacaaaaatctcctcaagaagaaacagaaaacctgaataggtctagtccttttgaaagtcaccatatccaatcagactagttaatcagctctaccaacacttcagaaatcangcactatccacaatatattaactatttcagagcacaggaaaagaaagtttcctaactctttctacgagactggcctgactctgataaacaagttagagagaaacatcacaaaacacagaaactgtgattctatccattttataaatgaagttgtaaaaccataagaagacatcagcagttgaatgcagatgtatcaaaacaacaatactcatgagcaaatggaacttatttcaaaaatgaaagaaaaagtttccaatttaggatttttttttttttttttttgaggcaaagtcttacagggctgcagtgcagtggtgtcatctcgactca

SEQ ID NO: 1617 - DNA, 661 bp, Homo sapiens
  PCSK6
  misc_feature [331]..[331]: Chromosome 15, SNP identification no. = rs2277585
  misc_feature [331]..[331]: allele = c, in linkage disequilibrium with rs1994967, respectively
  misc_feature [331]..[331]: n is a, t, c or g
acgcactcgtgaacggtgtaagtcctacggtccttcccgacatgggtccgactgaaccacggaagagggtctcaccccaaccactactctcccctacgtcctttacccgaaattactgtagagacccgaagcctgttgactgagagaacaacgtaacttgactcggtccgtgacttaagtgactttgaacgacccgacgcaggagtgaaccaaaaaaggaaacaaagtctgtgccgtgagcaacacgccctcttcaacgacgaagtcgtttgttaaggatgacgtagcacccgtatcgcatgttacggttttatcctccattccggcccgnaccgtcggacgctcggctccccggaccccgtccccgtcgaccctcgagggacaggcgaccagagtcgtcggaggacaaaaaaccgaaaccggtacagtcgtctggggacccggtctgcgtcgtcacggcagacatagtaccgggtccgtcgactgggtgtccctaaccccggagttctgtctccttgacgaatgacaaaacggacttttcggtaacgtcaagggtagtctttccatgggagagaggagaccaggacgaccggaccgacgactgaggatcttcagacgcaactaaggggcgacgggtatcgggagtcaccgaggcagtgaa

SEQ ID NO: 1618 - DNA, 661 bp, Homo sapiens
  misc_feature [331]..[331]: Chromosome 16, SNP identification no. = rs7187057
  misc_feature [331]..[331]: allele = c, in linkage disequilibrium with rs7200548, respectively
  misc_feature [331]..[331]: n is a, t, c or g
aaattgatgctgcagagagaatggctgctggttcactaatgaactcagatgggggcaggggctgggagcctggggctgggggctgcgttaggtttgaaatccaccgggtggtgtggattttgcatgggtattacaattggttaaaatccattaggcttggttggatcttacagcccccaggtatacaacccttgggatttctgggttgagaggggcccagtaaaaggacagcagctctggctagggctgataaggtcatgtgagcctccagttctccatgggggtgctctgggatgacgggtagcattagttccaatttgcaaacagggantcagcattaacccccagtggctccttaaagatgctcctcatccttcatctctgctacatccttaggcttggaggcactgggatttcagaagcaggcggaataccttctccccttggctacctattccttcaagctctcttcctccctcatctaggaagattctctaactgccagtacccgtcaattacaaaaccttccaggtactttggattcttactgtctgaagcagcacctctctacagaagtgacaaaaccgtcttctctccttgaccaaggatgacactgactgccaaaaccatgccagctgaaccccaaattccatagcctctc

SEQ ID NO: 1619 - DNA, 661 bp, Homo sapiens
  misc_feature [331]..[331]: Chromosome 16, SNP identification no. = rs7189118
  misc_feature [331]..[331]: allele = g, in linkage disequilibrium with rs7200548, respectively
  misc_feature [331]..[331]: n is a, t, c or g
tgcagagagaatggctgctggttcactaatgaactcagatgggggcaggggctgggagcctggggctgggggctgcgttaggtttgaaatccaccgggtggtgtggattttgcatgggtattacaattggttaaaatccattaggcttggttggatcttacagcccccaggtatacaacccttgggatttctgggttgagaggggcccagtaaaaggacagcagctctggctagggctgataaggtcatgtgagcctccagttctccatgggggtgctctgggatgacgggtagcattagttccaatttgcaaacagggagtcagcattancccccagtggctccttaaagatgctcctcatccttcatctctgctacatccttaggcttggaggcactgggatttcagaagcaggcggaataccttctccccttggctacctattccttcaagctctcttcctccctcatctaggaagattctctaactgccagtacccgtcaattacaaaaccttccaggtactttggattcttactgtctgaagcagcacctctctacagaagtgacaaaaccgtcttctctccttgaccaaggatgacactgactgccaaaaccatgccagctgaaccccaaattccatagcctctcatgaaactag

SEQ ID NO: 1620 - DNA, 661 bp, Homo sapiens
  misc_feature [331]..[331]: Chromosome 16, SNP identification no. = rs1865820
  misc_feature [331]..[331]: allele = g, in linkage disequilibrium with rs7200548, respectively
  misc_feature [331]..[331]: n is a, t, c or g
ttacaattggttaaaatccattaggcttggttggatcttacagcccccaggtatacaacccttgggatttctgggttgagaggggcccagtaaaaggacagcagctctggctagggctgataaggtcatgtgagcctccagttctccatgggggtgctctgggatgacgggtagcattagttccaatttgcaaacagggagtcagcattaacccccagtggctccttaaagatgctcctcatccttcatctctgctacatccttaggcttggaggcactgggatttcagaagcaggcggaataccttctccccttggctacctattccttnaagctctcttcctccctcatctaggaagattctctaactgccagtacccgtcaattacaaaaccttccaggtactttggattcttactgtctgaagcagcacctctctacagaagtgacaaaaccgtcttctctccttgaccaaggatgacactgactgccaaaaccatgccagctgaaccccaaattccatagcctctcatgaaactagaccttgcatctcctatctgaagctcctttctcaattattatgcctggccaggcatggatcatgcttgtaatcccagtactttgggaggttgagcccaggactttgagaccagcctgggca

SEQ ID NO: 1621 - DNA, 661 bp, Homo sapiens
  misc_feature [331]..[331]: Chromosome 16, SNP identification no. = rs7189684
  misc_feature [331]..[331]: allele = g, in linkage disequilibrium with rs7200548, respectively
  misc_feature [331]..[331]: n is a, t, c or g
aaacagggagtcagcattaacccccagtggctccttaaagatgctcctcatccttcatctctgctacatccttaggcttggaggcactgggatttcagaagcaggcggaataccttctccccttggctacctattccttcaagctctcttcctccctcatctaggaagattctctaactgccagtacccgtcaattacaaaaccttccaggtactttggattcttactgtctgaagcagcacctctctacagaagtgacaaaaccgtcttctctccttgaccaaggatgacactgactgccaaaaccatgccagctgaaccccaaattccntagcctctcatgaaactagaccttgcatctcctatctgaagctcctttctcaattattatgcctggccaggcatggatcatgcttgtaatcccagtactttgggaggttgagcccaggactttgagaccagcctgggcaacatagttaaacttcgtttctataaaaaaatacaaaattagccagatgtcatggattgtgcctatagtcccaactactagggaggctgaggtgggaggattgtttgagcctgggaggctgaggctgcaatgagccatgatcgtcccactgtactctagcctgggtaacagtgagacccctgtctcaaaaaa

SEQ ID NO: 1622 - DNA, 661 bp, Homo sapiens
  misc_feature [331]..[331]: Chromosome 16, SNP identification no. = rs7195375
  misc_feature [331]..[331]: allele = t, in linkage disequilibrium with rs7200548, respectively
  misc_feature [331]..[331]: n is a, t, c or g
cagaaaaatcagacatatcccattttgggttcagctgaggatatcccctttcctgtacatcttccctgcattgtaatccaattcagcgtcgtcttgcactcttgtgcactctctctctatctctctgtgtgtgtgtgtttgtgtgtgtgttggggtgtgcacttctaggagcagccatgtttctattacggtaattaaacacaggtgaaggatagcttggagctttgaaatccatattcttctccccagttcccctcacatttcttcttaaagcgagcttgctgacaagcaggtactgatggataacggaactctcactgatatcccattngtggttggagtttcaggtagttgcatttttacagtgcttggcacagtgtaggtaataaataaatgtcttttcaatgagtaagagagtgagaaattaatggatgaacaagtgagtgaggccaaaattctcatagctcagggaacaggagaaagtctgactaatgtttgggaagatggcatgacaccaagacccttagtgggagaagcccagctggagaggggagagagaaaggagaggggagagagaaaggggttcatgaagatggggctggagatgccgacagggtgcctgcagtgatgggtcttgtgggctgtattttttttttttttt

SEQ ID NO: 1623 - DNA, 661 bp, Homo sapiens
  misc_feature [331]..[331]: Chromosome 16, SNP identification no. = rs11648254
  misc_feature [331]..[331]: allele = t, in linkage disequilibrium with rs7200548, respectively
  misc_feature [331]..[331]: n is a, t, c or g
taacggaactctcactgatatcccattcgtggttggagtttcaggtagttgcatttttacagtgcttggcacagtgtaggtaataaataaatgtcttttcaatgagtaagagagtgagaaattaatggatgaacaagtgagtgaggccaaaattctcatagctcagggaacaggagaaagtctgactaatgtttgggaagatggcatgacaccaagacccttagtgggagaagcccagctggagaggggagagagaaaggagaggggagagagaaaggggttcatgaagatggggctggagatgccgacagggtgcctgcagtgatgggtnttgtgggctgtatttttttttttttttgagacggagtcttgctgtcacccaggctggagtacagtggcgcagtctgggctcactgcagctccgactcccgggttcgcgccattctcctgcctcagcctcagtagctgggactacaggcacccaccaccatgcccggctaattttttgtatttttagtagagttggggattcaccgtgttagccaggatggtctcgatctcctgacctcatgttctacccacctcggcctccaaaagtgctgggattacgggcgtgagccaccgcgcctggccaggtcttgtgggctgtattaagcgtatt

SEQ ID NO: 1624 - DNA, 661 bp, Homo sapiens
  misc_feature [331]..[331]: Chromosome 16, SNP identification no. = rs6500727
  misc_feature [331]..[331]: allele = g, in linkage disequilibrium with rs7200548, respectively
  misc_feature [331]..[331]: n is a, t, c or g
ccacctcggcctccaaaagtgctgggattacgggcgtgagccaccgcgcctggccaggtcttgtgggctgtattaagcgtatttgtctttatggtgaaagcagtagggtctttgaacagttttaagcaggagacaggtaaataaagatattcaataactttatccccattctgatcactagtaatgatacttcattagatcatcaccatccttagcattgttaccaatcattgagcagttgctgagccaggctgtgtgttaggaggtttctgtatctgactcaatggtgcctccaggcattgtgtaccgtcatcagttttgcatatgaggnaatggactgacagggtgaagaccattaccccggcaggaaagcctgagtttcattgcacatcatgccttgcaagggcttgtatatcatggggttctcgcactccccatatgaggggataccattgtgtcctatttcctgctcttgggtcgtggagaggtctataaggaacagagagctctgcctttctttactcagtcaataagttttttgagcaccagccatgtgccagatactgtgctaggctcaccttctgaaatccgtctcggaagacacaaggaacctctgaattggagatggtctaagtccattaataagcattttttgaacaat

SEQ ID NO: 1625 - DNA, 661 bp, Homo sapiens
  misc_feature [331]..[331]: Chromosome 16, SNP identification no. = rs2342743
  misc_feature [331]..[331]: allele = g, in linkage disequilibrium with rs7200548, respectively
  misc_feature [331]..[331]: n is a, t, c or g
tcatcaccatccttagcattgttaccaatcattgagcagttgctgagccaggctgtgtgttaggaggtttctgtatctgactcaatggtgcctccaggcattgtgtaccgtcatcagttttgcatatgaggcaatggactgacagggtgaagaccattaccccggcaggaaagcctgagtttcattgcacatcatgccttgcaagggcttgtatatcatggggttctcgcactccccatatgaggggataccattgtgtcctatttcctgctcttgggtcgtggagaggtctataaggaacagagagctctgcctttctttactcagtcantaagttttttgagcaccagccatgtgccagatactgtgctaggctcaccttctgaaatccgtctcggaagacacaaggaacctctgaattggagatggtctaagtccattaataagcattttttgaacaatatttactttgttagttttgacgagaaattagaagaattagataggacccttgttttcaaaaagttgtcagcatgggaggaagaaaacagagagtcttgaccgtagaggggacaacaaagaatgagcttcaaggtatgattaggagtgttgctggttactgctgcctgcagctaatgtctcccctgagcattggatccct

SEQ ID NO: 1626 - DNA, 661 bp, Homo sapiens
  misc_feature [331]..[331]: Chromosome 16, SNP identification no. = rs2342745
  misc_feature [331]..[331]: allele = c, in linkage disequilibrium with rs7200548, respectively
  misc_feature [331]..[331]: n is a, t, c or g
gttaggaggtttctgtatctgactcaatggtgcctccaggcattgtgtaccgtcatcagttttgcatatgaggcaatggactgacagggtgaagaccattaccccggcaggaaagcctgagtttcattgcacatcatgccttgcaagggcttgtatatcatggggttctcgcactccccatatgaggggataccattgtgtcctatttcctgctcttgggtcgtggagaggtctataaggaacagagagctctgcctttctttactcagtcaataagttttttgagcaccagccatgtgccagatactgtgctaggctcaccttctgaaanccgtctcggaagacacaaggaacctctgaattggagatggtctaagtccattaataagcattttttgaacaatatttactttgttagttttgacgagaaattagaagaattagataggacccttgttttcaaaaagttgtcagcatgggaggaagaaaacagagagtcttgaccgtagaggggacaacaaagaatgagcttcaaggtatgattaggagtgttgctggttactgctgcctgcagctaatgtctcccctgagcattggatccctgtgtccattatgttctatgcatacctcatgctcaaaggggctacagtgggagagagga

SEQ ID NO: 1627 - DNA, 661 bp, Homo sapiens
  misc_feature [331]..[331]: Chromosome 16, SNP identification no. = rs2342747
  misc_feature [331]..[331]: allele = g, in linkage disequilibrium with rs7200548, respectively
  misc_feature [331]..[331]: n is a, t, c or g
ccatatgaggggataccattgtgtcctatttcctgctcttgggtcgtggagaggtctataaggaacagagagctctgcctttctttactcagtcaataagttttttgagcaccagccatgtgccagatactgtgctaggctcaccttctgaaatccgtctcggaagacacaaggaacctctgaattggagatggtctaagtccattaataagcattttttgaacaatatttactttgttagttttgacgagaaattagaagaattagataggacccttgttttcaaaaagttgtcagcatgggaggaagaaaacagagagtcttgaccgtngaggggacaacaaagaatgagcttcaaggtatgattaggagtgttgctggttactgctgcctgcagctaatgtctcccctgagcattggatccctgtgtccattatgttctatgcatacctcatgctcaaaggggctacagtgggagagaggactccttttatgtcccatagtctgtgtaaatggttcctccacccaccaaatacatcacctttgactcatctctttcccttgttccatccttacaatggatgggtcttaattacctcttggatctgtccccatctccatctgtccttctcctcctctgctccatttccccctccttgtc

SEQ ID NO: 1628 - DNA, 661 bp, Homo sapiens
  misc_feature [331]..[331]: Chromosome 16, SNP identification no. = rs2342748
  misc_feature [331]..[331]: allele = c, in linkage disequilibrium with rs7200548, respectively
  misc_feature [331]..[331]: n is a, t, c or g
ttcctgctcttgggtcgtggagaggtctataaggaacagagagctctgcctttctttactcagtcaataagttttttgagcaccagccatgtgccagatactgtgctaggctcaccttctgaaatccgtctcggaagacacaaggaacctctgaattggagatggtctaagtccattaataagcattttttgaacaatatttactttgttagttttgacgagaaattagaagaattagataggacccttgttttcaaaaagttgtcagcatgggaggaagaaaacagagagtcttgaccgtagaggggacaacaaagaatgagcttcaagntatgattaggagtgttgctggttactgctgcctgcagctaatgtctcccctgagcattggatccctgtgtccattatgttctatgcatacctcatgctcaaaggggctacagtgggagagaggactccttttatgtcccatagtctgtgtaaatggttcctccacccaccaaatacatcacctttgactcatctctttcccttgttccatccttacaatggatgggtcttaattacctcttggatctgtccccatctccatctgtccttctcctcctctgctccatttccccctccttgtctctgctttctctccatccacaggtctgtt

SEQ ID NO: 1629 - DNA, 661 bp, Homo sapiens
  misc_feature [331]..[331]: Chromosome 16, SNP identification no. = rs7200468
  misc_feature [331]..[331]: allele = c, in linkage disequilibrium with rs7200548, respectively
  misc_feature [331]..[331]: n is a, t, c or g
taagggccctaatcccattcatgaaggcttatgcctgtgacctgaccacctcccaaggggcctcacctcttttaggggacacaattatttagaccacagcacctgggaggttagcaatatcttcctatggtgcctctctgcttccatctatgctctgcttctgctctagagtggtctttcaaaagcatgacctcactgtgccacttctatgaaaccctacagaggtttcactttgcttgcaggaagcagtgcaaactgtattttggaacacaggttctttctgacctgggtccttatcttctgccatttacctcttggaagacttacgttntactgacgctggactacttgacatttcctatccaagttgtgtctccaggcccttatctatgctgctcccactgcctggaataccctttccctctgccatgcccaccaggtgaatcacagcttatcctttaagacatggctttagtttctttcaacaaatattattgagcactttctttacatgctagatcatgccctaggcaggccctggagccccagaaatgatggataaatgaggagctagctttgtacctcaagtgccctgtcactttttcattcatcactcacctccgttagagagggttggcctttctgctggcctttatcgtcg

SEQ ID NO: 1630 - DNA, 661 bp, Homo sapiens
  misc_feature [331]..[331]: Chromosome 16, SNP identification no. = rs1550137
  misc_feature [331]..[331]: allele = c, in linkage disequilibrium with rs7200548, respectively
  misc_feature [331]..[331]: n is a, t, c or g
ccacctctaggaagtggttgttgctgtcattcccattttatagatggaggaagcagagctcatggggattaaaacacttgcccctggtccatactcaccccatagcctgactgcaaagttcattctcttaaccgccatgctacattgtcttattcagttctttgtcttcggcacatcacgtggaatagggcacagagacgtttgctaaaggaatcttactgtctttatataaatcctgcaaggggggaggcaggaacagatgacattggagaagaggtggggtgaggaaggaccatcccggtgaccccggccacgtggctggaccgtgccnggattgatcagcattagcagcaccagagctgcagctgcccgcacgtttctagccacaagggaggggaacccaccccagcttcttttcatcatcagcctaactaatttcttcccccacctgcttttgtgtttttgcttggcggttgtcagagggcacctgaaaatgagcttggtgagaaggaacgttttccccatgaatcagctctgaaatcattcctctgaagtgcgtcacagcgttaccctgaattgttgggacgcgactccagcagcgtcctgagtgacaccgttcccccgtctgtctcctgtgctctcccagcctcacaggggttta

SEQ ID NO: 1631 - DNA, 661 bp, Homo sapiens
  misc_feature [331]..[331]: Chromosome 16, SNP identification no. = rs2343252
  misc_feature [331]..[331]: allele = c, in linkage disequilibrium with rs7200548, respectively
  misc_feature [331]..[331]: n is a, t, c or g
agctatgaggatgcaaaggcataagaatgatacaatagactttggggacttggggggaatagggagaggggcaagggataaaagacaacaaatatggtgcagtgtttactgcttgggtggtgggtgtggcaggttctcacaaatctccactaaataacttactcatgtaaccaaataccacctgtaccccaatagcttatggaaaaataaaattaataaatacaaataaaaaataaaaagttatttataattgagtgggttctcactaataatagtaataaataagttctggagatctactctatagcatagatcctatagctacaaatantatattgtgcacttaaaattttccaaccacaaagaaatggtgggcaagaattgaggtgataggtacatttaaaatacacaatgctgctacaagaattacggaattatgtcttgtgtctgtggaattatgtcttcttgggtttccaacccatggcctggagagtccatcctgggctcctggagtgtgcaagttggaaggaattggagatggtttgttgtcatggttaagtgcatggactttggaacctagctgcccaggtttaagttccagctctgccatgcacatctttgggaccttgagtgtgttgcttaaaatgcatctgaaaggcat

SEQ ID NO: 1632 - DNA, 661 bp, Homo sapiens
  misc_feature [331]..[331]: Chromosome 16, SNP identification no. = rs9930544
  misc_feature [331]..[331]: allele = c, in linkage disequilibrium with rs7200548, respectively
  misc_feature [331]..[331]: n is a, t, c or g
tcttagcgtattaaacccttctgcctacccattgccttaccctgaggatcctggaggactgtgagagtcctgggcacatagagggcagtcggatactgacgcagtgagtggatgaacacccattcactttgctattctagcataagtccttacacatagttggtacttgataactattttggaagtgagattagaggttgagtatgtgaacagataaataactgaataccagatggcaagtacataaaggaaggggtagctcctgcctcttggaactaatgagctggcagagtcgtaaccaaatgcaacatagcatgtgaagtgttctatngagggaatagtcgatattgcttattgagaatataatatgtgtcaggcactgccctctatggctggggtccccaaaccccaggccacggactgctaccagtccatggcctattaggaacccaaccacacagaaggaggtgagttgcaggcaagtaagtgaagcttcatctttatttacagccactccccatcactcacattatcacctgagctccacctccagtcaggtcagtggcagcattagattatcataggagtgcaaatcctattgtgaactgcacatgtgagggatctaggttgcatgctccttatgagaatttaatgcccgatg

SEQ ID NO: 1633 - DNA, 661 bp, Homo sapiens
  misc_feature [331]..[331]: Chromosome 16, SNP identification no. = rs4296263
  misc_feature [331]..[331]: allele = g, in linkage disequilibrium with rs7200548, respectively
  misc_feature [331]..[331]: n is a, t, c or g
tggtggccctcttctacctcctccaacatccccctccatcccctccttttctttctctcttcagtaacagcccctgctcatgatctcccatgggctgtgtagatctgctgtccatgagccaggcattgacgcaagagaacaaaggcattgctaatgctgtaaatcctggatccaatttatttgttatttccactcatttgaaatgcacctgttgccccaaaggcctttgaatgccatcagcagcaactacagaatcaaagagaaattagaaccttttggaaaagccctcagtcattcagaagggaaacaaaaacaggggggaagaaaaggnctttggtttttttttccccttaggtgacttactggcatagacggttgggcttctgaaagacccttaggagcaaggatctgaggctgttttctttttccttcctcttgcttccagtctcttcgtttgctcaatacattcaaatagccatgacatttccttgtagggtttttaaaacaccacactgccacttttcttcaggctaggattgtctagcatccatcttgtgggctgcaatgctcatttgcaaatcgtcctggatacattggcagctcagggtctgatattacccagctaatccagtgttttgttagagaccatttgccccgcagt

SEQ ID NO: 1634 - DNA, 661 bp, Homo sapiens
  misc_feature [331]..[331]: Chromosome 16, SNP identification no. = rs2118014
  misc_feature [331]..[331]: allele = a, in linkage disequilibrium with rs7200548, respectively
  misc_feature [331]..[331]: n is a, t, c or g
atatatcctattctggctcccatccagttaggatgctgcagatgagccgggaacgggaaacttgctatctcatgtgcttagatgactgtttggctgcccgtcctctttggttgttagatcaagggtgataaattctgtctttcttccaatgatactttgggacatccatgttagcctgttttttcatctttggggcccagcagtcactttctctctctagacctctgttttcttatctgcaaagtgggaatttggatggatgaatatcttcattgctttcagttctaatattggtgacagctcagtcacaaagcaagcgcaaaaaaatctntctctgcaaacagtagttgttacagttaacgtgaactaagcactttttgcagactacctcagtgagctctcacaccattttacaaatcaggaaagagaaacccagagggtagtttccttgctcaagatgactttgagaggtgtgcttctcagctggaggaaaagtttgcaccccagaggacatttggcaatatctgaaagtatttttggtttcacagctcgctggggagtgctcctggcatatagagtagaggccagggatattgataaaccacctccaaagcacaggagaacacctacagcaaagaattatctggtcccaaatttcaac

SEQ ID NO: 1635 - DNA, 661 bp, Homo sapiens
  misc_feature [331]..[331]: Chromosome 16, SNP identification no. = rs7200548
  misc_feature [331]..[331]: allele = c, g
  misc_feature [331]..[331]: n is a, t, c or g
atcttgcttcccctatgtcctgacagcgctgtccttggttgaaccagaggcagaacatctgcatggcagtgaatcacacagctcttctgaagaggctggaaaaacaaagccacacccagagaggccaccccctgtccccagcgtctgagggcgcatgagatgaggtgaggctgtgtgccccagaggatgctgtgctctgcggggtagaaagtcattttgtgctgataggcctggcggtgacctggctctacacctctcctgtgccttcagaacaccaggaacacagctcccccactgccatcatgatctttacataaacactgagctctanaagaagaggcttaaatgggggaaggagttgctgggatgagagtatgggcttcacagaatgaaaacatgtcaaaaggggaggattagggttacttagaagtgaggccgtgggtcaccactgcttggagatgtgtgtaggtgaagcagaaggagccttctcacagcacactggctttagcatggcctgtgtgatccacctggggatgcagtgagttccctatcatggaaaacacacagacaaaacctaggggaaccactctcagtgttgccgagagccagtgcctgtctgggtgagagcttggactgccagaagcttcctgccaacaaggtc

SEQ ID NO: 1636 - DNA, 661 bp, Homo sapiens
  MGC3248
  misc_feature [331]..[331]: Chromosome 16, SNP identification no. = rs249856
  misc_feature [331]..[331]: allele = a, in linkage disequilibrium with rs26764, respectively
  misc_feature [331]..[331]: n is a, t, c or g
ttatcccctccttgtatttttatcatgaataacatatgtctaatacaaggttaagaagtcaacccatatcccaagtgaccacaactaaattaaaatacgaaatactgtatatacagtgtatataagaaaacatatgggttttataacggtttaatttgtagaaatttttcgttttccatcggtccgtaccaccgagtacggacattaggttcgtgaaaccctccgactccgtccgtctagtggactccagtcctcaagttctggtcggaccggttgtaccattttggggcagagatgatttttatgtttttaatcggtccgtacctccgtncgttgacattatggtccatgacccctccgactccgtcctgttaacgaacttggacccttcacctccgacgtcactcggttctaaggtggtaacgtaggtcggacccgttgtcccgttatgaggtagggggagggggtttttttttaattttttttttttcgtttgtcgggagttatccgttttgttagaatattttcttgtttgtaccttctgagtattaagtactaatttttgaataatatcatccggctcgtgtcaccaagtgtggacattagggtgatgaaaccatccggttccgcccgcctagtggactccagtcctcaagctctg

SEQ ID NO: 1637 - DNA, 661 bp, Homo sapiens
  MGC3248
  misc_feature [331]..[331]: Chromosome 16, SNP identification no. = rs249870
  misc_feature [331]..[331]: allele = a, in linkage disequilibrium with rs26764, respectively
  misc_feature [331]..[331]: n is a, t, c or g
attataaatcgatatttttccttttttattattagacgatgatatacgttgttctacctatgtagagtttttgtaatacgacgcacttttttcgaactgtattttctcatatactaagattgggtctataggtacttacccgctttcctatttcttttacaccatatatagtgaagaaccggaaaaccgattctagttcacttcttttacatcatatatatgtattaccttataataagtcagtattttttcttgctttaggacagtaaacgtcgttgtacctaccttgacctccaatgatataatttactttattcggttcgtgtctttntgtatatagtgtgcaagagtgagtatacacccgtgattttttcgtctaaagttctgtctctcatctgacaaccaatggtttccggttctttccatcctccttccttctccccaattaattacccgtgtttatatgtcgaactatcttctttattctggatcttaaactatccagtcatcccactgatgtcaaatgtcattagataatacataaagttttgtcgatcttcctttattaaaaaaaatttgaaaattcaagtccccatgtatacgtccaaacaatgtatccatttgaacacagtacctccaaacaacatgtgtaataaagtag

SEQ ID NO: 1638 - DNA, 661 bp, Homo sapiens
  MGC3248
  misc_feature [331]..[331]: Chromosome 16, SNP identification no. = rs249869
  misc_feature [331]..[331]: allele = t, in linkage disequilibrium with rs26764, respectively
  misc_feature [331]..[331]: n is a, t, c or g
cggagttctttttttttttttttaattcgtcccgtaccaccgtgcacggatatcagggtcgatgtggtctccgactccgccttcctagtgattcttagttccgatgtcactcgatactatcacggtgaacgacgtgaggtcggacccgttgtctcattctgagacagagtctttttcttttttatttattcattcttattttttgagatcgcaagggatggggtgggatcagtttgatcctgaactcaaatgttccactcaaatctctacttcgtttttacagtcttataacgattaataccttcgaccatttactcaaacacccttaagnaatatataggagagatgaaaacatgtacagaattttcaaggtattactattataaatcgatatttttccttttttattattagacgatgatatacgttgttctacctatgtagagtttttgtaatacgacgcacttttttcgaactgtattttctcatatactaagattgggtctataggtacttacccgctttcctatttcttttacaccatatatagtgaagaaccggaaaaccgattctagttcacttcttttacatcatatatatgtattaccttataataagtcagtattttttcttgctttaggacagtaaacgtcgttgtacc

SEQ ID NO: 1639 - DNA, 661 bp, Homo sapiens
  MGC3248
  misc_feature [331]..[331]: Chromosome 16, SNP identification no. = rs249867
  misc_feature [331]..[331]: allele = a, in linkage disequilibrium with rs26764, respectively
  misc_feature [331]..[331]: n is a, t, c or g
agggtcgatgagccctccgactccgtcctcttagcgaacttggaccctccgcctccaacgtcactcggctctagcgcggtaacgtgaggtcggacctgcttttctcactctaaaacgaaattctgtgtcccagagtgagacaacgggtccgacgtcacgtcacggtgttagtatcgagtgacgttggaactcgaggacccgagttccctaggagggcggattcggaagacacgtcgaccctgatgtccacacacggtggtgtagggtgattaaaaatttacaaaacatctctacctcagagtgatacaacgggtgcgaccagaacttgggnatccgagtacgttagttaggaggttgaaactggagggtttcacgacgctaacgtccgtaatctgtgacgtgaaccggggtcataaaatttgtttcctaattgtatgtatttaaaggcataataatgatgatgagaccttcgtgggaccgtagacgtacctcctatgtccactctctggactccttttgactgggaaatctactgatgttacctagttccatttttatctattactcagaaataaaaaaaaaaaaaaactctacctcagaacgagacagtgagtccgacctcacgtcaccgtactagaaccgagtgacgttggggcggagg

SEQ ID NO: 1640 - DNA, 661 bp, Homo sapiens
  MGC3248
  misc_feature [331]..[331]: Chromosome 16, SNP identification no. = rs34514
  misc_feature [331]..[331]: allele = a, in linkage disequilibrium with rs26764, respectively
  misc_feature [331]..[331]: n is a, t, c or g
cactgtccacatagtgtagtatatcatcgacagtatacagcgatagactaatacgattaacgaagatgttgatctgaaacccttggaactccgtccttaaaataaaatagatagaaatatataagagtcgaatgttgggtcgacgtccgtactccttccacgagttatttacgaacgactgaataacctactttacgtctacccacggtcctcccgttaatcagttcctcctctcttcgtttctccgtttctcttatgaaatcgtggtaatagtcgataccaccagtcaaacggacgagacagggaccggaaagaacctgtcagaaataanggtgacttcctagtcacctggactgaactgagacgggaaacccagtttcagcaagtctagtccctatgaattctactcagttagtctaagagagagagttctcaaaccttcattgtgtattctagagatcaaccacagacgaccttcggatttacctctttactatatttaatctccgactcagtcgttccatccgaggtacttgtttaccccgtccatagacactctctcttttccgttcatctttacgtctctcttcccgtcatatcttcttttttatgtcagagtctatgtctctccctatccatctgttttgtcagaactaaggcc

SEQ ID NO: 1641 - DNA, 661 bp, Homo sapiens
  MGC3248
  misc_feature [331]..[331]: Chromosome 16, SNP identification no. = rs34513
  misc_feature [331]..[331]: allele = g, in linkage disequilibrium with rs26764, respectively
  misc_feature [331]..[331]: n is a, t, c or g
atactaatgatcaagttttaacgttatcatgtggtttctttatactttcctttttggttccgtcctccccgttctagaagtttcgattttctcgtccatggtttatttttagttacttgcaaacaagtaagggtgaaggaaacttttacgagtgtctagtgtaaaaatcattggacgggatattacaaggtcccctaactgtcatccgagtactcaatattaaaggtgtaagtcgtaagatttttaaataagtaagtgtctgaagtcactcactgatgatacacggtctgagttacgatctttaatcccgatattattactgttttctctntcttgtgacaggtgctcgtcgaacgttagttctcttctttactctaatttatcattcatcactgttgacactattcccgatgtctttgtgttatagttcaatactcgtatatattgttcctctggaatggatcaggtacctaaatcctttttgaattaactgaaactcatcctcagtcgtccgaaagaggtctatagactgtagtaagggtagggcaagagatcccaaggagtttacagtgactgtcaccaagacactagtgtaaatatacattaaagatatggaaccctacattttataaacctgaccttacttatatttcacgatcta

SEQ ID NO: 1642 - DNA, 661 bp, Homo sapiens
  MGC3248
  misc_feature [331]..[331]: Chromosome 16, SNP identification no. = rs35586
  misc_feature [331]..[331]: allele = g, in linkage disequilibrium with rs26764, respectively
  misc_feature [331]..[331]: n is a, t, c or g
gagctcatggaagactgaaattcagtctgtaatgtctgagacagtttgtcctgcctctagcatacagccttccccccgaaatgtacacaaacacacactctcacaaccttgctgcctccttctcgtcaggtaccacctgaagcaggaagttgcaaccaaccctcttgtcaccgtccctggctattacatggtatcatgaatggggaaaatagaaaggagcctttcacacagtagactgatccatttcctattaacaagattttaatttcaggggcgccgatgtgtgttgaaagactgctgcaaaattcttgacaacacagtattacctccngaaactgtggttccaccattcactgtcttctcaggctgcccaggtaaccttggctgttgattaattttattttaacttcctaaaactcagttgtattttccatcgcaaaagtaatgcttacgattcctatctctggcaatatgttgatagagctaacttagaaattcacctgtacaaagtacctagaaatgctacctaacatataacaagcatctgtttaaatgcataattgggttcaccagaaaataaggaaattatgaagggccaaacacaaagaggaaactaagcccaagctgtgagattgcacgggttaatgctgtcttcataata

SEQ ID NO: 1643 - DNA, 661 bp, Homo sapiens
  MGC3248
  misc_feature [331]..[331]: Chromosome 16, SNP identification no. = rs35585
  misc_feature [331]..[331]: allele = a, in linkage disequilibrium with rs26764, respectively
  misc_feature [331]..[331]: n is a, t, c or g
aaggaactctcccttaggaaattctcataaactcctagagagacggtacacacctaggttccgaaataaaggtagggctgtactcatagtggggagtttagtgagataatacttctgtcgtaattgggcacgttagagtgtcgaacccgaatcaaaggagaaacacaaaccgggaagtattaaaggaataaaagaccacttgggttaatacgtaaatttgtctacgaacaatatacaatccatcgtaaagatccatgaaacatgtccacttaaagattcaatcgagatagttgtataacggtctctatccttagcattcgtaatgaaaacnctaccttttatgttgactcaaaatccttcaattttattttaattagttgtcggttccaatggacccgtcggactcttctgtcacttaccaccttggtgtcaaagacctccattatgacacaacagttcttaaaacgtcgtcagaaagttgtgtgtagccgcggggactttaattttagaacaattatcctttacctagtcagatgacacactttccgaggaaagataaaaggggtaagtactatggtacattatcggtccctgccactgttctcccaaccaacgttgaaggacgaagtccaccatggactgctcttcctccgtcgttcca

SEQ ID NO: 1644 - DNA, 661 bp, Homo sapiens
  MGC3248
  misc_feature [331]..[331]: Chromosome 16, SNP identification no. = rs7588
  misc_feature [331]..[331]: allele = a, in linkage disequilibrium with rs26764, respectively
  misc_feature [331]..[331]: n is a, t, c or g
aagatggaatacaccaaatggacaggcctggcatgtacccacagagactgagagttggtgctggtggttgtggtggcagatgatattacctgaagaagggacgaatgggtgctgggcaggacaaagcatcagctgtccagttcaggcctctcctctttccctggtgtcttcattttcctccgtctccctgctgtcccttaccctctgcccaatctctcattactcctggtcttgggagttgccttctgaggatactccactgggggtacctgagcctggattagagggcagggggaggatattgcctagccaaagtgggtgttcaataaanaaccatttggagatggtcttctgtctggaactgcttcctttttgttttattatttttccccagatgagctgactgggccatggaactgcatccttatggttcccatagcaccttaccgaggcgcccttatcaatagagttttagttatgtacctgtgttcttgtctgaacccctactaactgtgagctcctgaggagtcaggcctgagtctgtgggtcatctagcacatccttaatagaatgattgcctggatgtgaccaccctcacccccaaccctcacacaccctgccagcatgcctcagaccttaccccagctcaagataagtctca

SEQ ID NO: 1645 - DNA, 661 bp, Homo sapiens
  PLK1
  misc_feature [331]..[331]: Chromosome 16, SNP identification no. = rs40076
  misc_feature [331]..[331]: allele = g, in linkage disequilibrium with rs26764, respectively
  misc_feature [331]..[331]: n is a, t, c or g
gggaggaagattcctgggcaagccttgctacatacaaggagcagaggcttgtgggatcagatggccctggttctggatggtcaaaccttaactagccttctgcattgacagatgtcagaggctggcatctaagtaccaactcttcctccctctgtcccaggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtaagttgggagttgtctctggaccnacctggtctcagcaggggcaactttgggacatcctacctggctgaccttttctgtggacctttcggcctgctttacagaaagcctactccaagggacaagtcatccccaaacaaagcctaattgtcatatctttccctgtcactggtgtatcctgtcggatttctgcagcctaggtcatgggtacagcggaggaggaggagggagagtctccacaaccttactgtagtcctttgctagagttgtccacagggcagcatcaccatcatctgggaacttgtatacacaatctcaggacccagactacttactggatcagaatctggattttt

SEQ ID NO: 1646 - DNA, 661 bp, Homo sapiens
  PLK1
  misc_feature [331]..[331]: Chromosome 16, SNP identification no. = rs35635
  misc_feature [331]..[331]: allele = g, in linkage disequilibrium with rs26764, respectively
  misc_feature [331]..[331]: n is a, t, c or g
tacctccggatcaagaagaatgaatacagtattcccaaggtgactaatgatgctttaagtttacatttattttgttttccccagaagctgtttatggagcccagcaatatcctaggaccagaaataggtctatcccacctctaaggtagccacagagcttgagagggcctgtgtctgaaattgcatacagaacttgacatgtatgtgcacataagcattttttctagggggagagagttggcagattctcaagagattgggtaacccaaaagttgtgtaaaaagcaaaaaacaaaggaggtaggaaggagtaggaggcaaaagtgcttaanctttagaaatggtttatcttaattcaaatggattctgccacttagcgagatcacattgggcaaatggcctgcatcttttttttttttttttttatttgaggtggagttttgctcttgttgcccagtgcagtggcatgatcttgactcactgcaacctccacctcccaggttcaagcgattctcctgcctcagcctcccaagtagctgggattacaggcacccaccacctcgcctggctttttttttttttttttgtatttttagtagagacggggtttcaccatgttggccaggctggtctcgaactcctgacctcaggtgatccacccg

SEQ ID NO: 1647 - DNA, 661 bp, Homo sapiens
  PLK1
  misc_feature [331]..[331]: Chromosome 16, SNP identification no. = rs42873
  misc_feature [331]..[331]: allele = c, in linkage disequilibrium with rs26764, respectively
  misc_feature [331]..[331]: n is a, t, c or g
cccaggttcatggcattctcccgcctcagcctcctgagtagctggaactacaggcaccagccaccatgcccggcttcttttttctgtatttgtggtagagacagggtttgaccgtgttagccaggatggtctcgatctcctgaccttgtgatccacctgcttcggactccctaagtgctgagattacaggcgtgagccaccgcgcccggccatggtgtgcattttcacaaccaccaacagaaatacatttaaaggaatagctggttcctgcagaagcctagcacacagccagtttgaagtgtagtgtccttgtgtgaagccaggaggcctntcaccataaggacagacatagtaaatccatcacaaagtgtcagttcactgtcagagacagcatggaatcaagccagctagacaaggccttcaccctctctgtgcctcactttcctcctctgtgaaaaagggatgataatagatccccaccccttagatgagttggtgagggctaagtgagctaaacacaggagtgcttagaatgctttcctggcacatagtgagtgctaggaaagtgagttggtgttcggccacagtccattgacccttctgtcaatggtgctcagtaaagctgacagtggagaacttggcattgaaccaagttgtgaac

SEQ ID NO: 1648 - DNA, 661 bp, Homo sapiens
  PLK1
  misc_feature [331]..[331]: Chromosome 16, SNP identification no. = rs35634
  misc_feature [331]..[331]: allele = t, in linkage disequilibrium with rs26764, respectively
  misc_feature [331]..[331]: n is a, t, c or g
gttttgggacagaaatgatttttatgtctttgatcgacctgtaccaccgtgtggacatcaggatcgatgaaccctccgactccaccctctcagtgaacttgcgtcctccacctccgacgtcactcggtactagaacggtgtcgtgaggtcggacccgttgtttcgttcttacagagtttatttattattatttatcatttattattaaaaaattttgtggccattgttttttccgtcctccgaccttatttattttgtcagacaggtttacaactattgatcatttttatctactttgtaccctgagtagtatgtcaagagaggtggaagnccattgacttttaaaggaattcaaaaattttacgatatattttttaattttgactttctttttttcatcctcagactccgtcctcctagtgaactcgagtcctcaaactctggtcacacccgttctggagtagagatggtttttaaatttttaaccagtctgcgccaccgtgtacggatttcagagttgatgaaccctccgactccgacctcctagtgaactcgggtcctctagtttcgatgacactccatgctgacacggtgacgtgaggtcgggccctctgtctcgttctgggacagagtttaaatttttttatttattttcgtctct

SEQ ID NO: 1649 - DNA, 661 bp, Homo sapiens
  PLK1
  misc_feature [331]..[331]: Chromosome 16, SNP identification no. = rs26767
  misc_feature [331]..[331]: allele = c, in linkage disequilibrium with rs26764, respectively
  misc_feature [331]..[331]: n is a, t, c or g
tccttccactgtttttgtccccgcaacccttcccgtgccctgaggggacggtgtcgactttgagaaggctttctttttaagagaatcgatggtgacgaaacccctttgacttagtcacggaccaatgatctcgtcgtcgacggtacgagtccactgtccgtgtatcacgagtgacactccgttgtctagaagtcttcggcaccggagactgggttgccacaccgggacgtcctactggacggtgagtccgtttgtcgaacttccgtggtcgtcgagtctcgacgggtcgaaactcgtttcttacctttcgtagaagtcgtaggtccgtctnccttcccgactcatcaagtcaagtaggtgtcttacctaagtcatccgtaaatttatttttgtgttctttaaaaaaaggtggggttttaaacgaaatatacgaataaatattggttttttcgaacttttctattgtactttaaaattgcgactaatatagacccgtcatctttgtgtctaataagaataacagaaaaaggaataaataaataagggggtggtggtacacgattaagaggaacatattatattttacaaattcaaaagttaattttttgctacagtactatccctgaacccatactttattattctataatccctaaacgaa

SEQ ID NO: 1650 - DNA, 661 bp, Homo sapiens
  LOC388226
  misc_feature [331]..[331]: Chromosome 16, SNP identification no. = rs27770
  misc_feature [331]..[331]: allele = g, in linkage disequilibrium with rs26764, respectively
  misc_feature [331]..[331]: n is a, t, c or g
tcctcaagctccgacgtcactcggtcctagtacggtgacgtgaggtcggaccaggtgtctctctgtgacagtgggggaaagggggtgttctgaccgtctccgacccgtcggaccccgactacttcgtctctacaagcgacctagggtccgggaccgtggggagtcctttatgttctttttcttataagtgtagacaaattacacgtatttcggttcctttcctgtcaaggcttaagttatctttataagacatgttaagtataccaccccaactccccctccccctgttccgacatcttgggtgtgggcttgtacatgtttttattgaatntgtcgttgggggtggacgttcctactacgtcgagacgggtcggtggccccgaccccccgtgtgacgtctgtaccgtggcgccctcggttggtcatacccggggtctacgtccaccctcactcctcccgtggtcaggcctcccctcccgtcgataatcctccggaactctgccaacgaccggctcgcactcgagtcgtcgaacaggtggtatcacgcccgcatcgcctcggccgaccggtcgaggaacgtcgtcggcatgaggaggtcctctgagtccgccatacacgccttcagggcgaagagcagctacatccagtgccgacggtagtc

SEQ ID NO: 1651 - DNA, 661 bp, Homo sapiens
  LOC388226
  misc_feature [331]..[331]: Chromosome 16, SNP identification no. = rs35633
  misc_feature [331]..[331]: allele = t, in linkage disequilibrium with rs26764, respectively
  misc_feature [331]..[331]: n is a, t, c or g
gagaaggaaatctctgcttccaggaagtcagcctggctaaattctcccatgggctgatagagctgccaggggtttggctcagactggaactcaagatgcttcctgggcagcatctccttggctctagatccctcccctctacactactatagggggcccatggttttcatccaaaacctttgcccttactgagctagttcaggtttccaagcttcattcctgcagggtatagggttacataagtgggtgccatacatgaggcaataaggcaatcaggaggactgtggtgacctggcatgggttttttctgcaggggcagctggtccttagnttcaaccggttgtcaccaggggactctccagggtggcagagctgattttgtttttttttttgttggggctttgctcatgttgcccaggctagagtgcagtggcgcaaccacagctcactgtaacctcaaactcctgggctcaagcaatctacctcggcctgagtaggtgggactacaggcatgtgccaccatgcctgaccaatttttaaattgtttgtagagatgggtcttcttatgttacccagcccgatcttgaacttttggcctcaagcgattctgattttttttttttttaaagaaaatccagaaatccaaattttatgtggaatt

SEQ ID NO: 1652 - DNA, 661 bp, Homo sapiens
  LOC388226
  misc_feature [331]..[331]: Chromosome 16, SNP identification no. = rs26764
  misc_feature [331]..[331]: allele = c, g
  misc_feature [331]..[331]: n is a, t, c or g
ctgcagtgagctatgattgtgccactgtactccagcctgggcaacagagcaagatcctgtctccaaaaaaataatgatgaaaaaatgacagcagacactcctagagtgctcaattacgtagcaggctctactcaaaacactcttcttaattcatgtagacctaaccaccccactatagtggcttttaataaaccagctttgcagctaaatctgcccctggcttttctctgttcctgactgccctgtcttgttcacacaggctcaccttcagggtcgtcgagtggctgggcttgctttgagggactctgaagcctcttctggctcctccggntggcccccgagtgcagggactgggcatcctgggagatgtgagcaaagtctgcaggtgccaggggggtctcctgctgcttctccaccacctgcggctgttgctgtaacatgagagcctaagagagctttgtcctggccacgccctgccccgtgatgggcccagtatctgtgactgagatggcctcaccagactgcatgaacttacagagcaagatcgcaggggcctggggagctgctgggagggaggcagggggcaaaatcagagctgggtagagggagagagttgctgagtggtctcagagaggagaagcagcgttctccccagatagac

SEQ ID NO: 1653 - DNA, 661 bp, Homo sapiens
  LOC388226
  misc_feature [331]..[331]: Chromosome 16, SNP identification no. = rs26763
  misc_feature [331]..[331]: allele = g, in linkage disequilibrium with rs26764, respectively
  misc_feature [331]..[331]: n is a, t, c or g
gacacgacccactacttcttttcaatccccaagggaccaccttcccccacgattttcacttcccgggaaataggggtcgataactcggactcggctctctttgaaaccctgaggctcgacgtaggtcttcttttttgaggtctgagaatgaaccccgaccctggggttctggacgaccgtcgatcggagtgacgacaggaggaccctcccacctaagagaaacactactccgtccatccgggtggcgggactggagtccagatagacccctcttgcgacgaagaggagagactctggtgagtcgttgagagagggagatgggtcgagactnaaacgggggacggagggagggtcgtcgaggggtccggggacgctagaacgagacattcaagtacgtcagaccactccggtagagtcagtgtctatgacccgggtagtgccccgtcccgcaccggtcctgtttcgagagaatccgagagtacaatgtcgttgtcggcgtccaccacctcttcgtcgtcctctggggggaccgtggacgtctgaaacgagtgtagagggtcctacgggtcagggacgtgagcccccggtcggcctcctcggtcttctccgaagtctcagggagtttcgttcgggtcggtgagctgctgggacttccactcgg

SEQ ID NO: 1654 - DNA, 661 bp, Homo sapiens
  LOC388226
  misc_feature [331]..[331]: Chromosome 16, SNP identification no. = rs26762
  misc_feature [331]..[331]: allele = t, in linkage disequilibrium with rs26764, respectively
  misc_feature [331]..[331]: n is a, t, c or g
attaagagtttaggccaacgagtagtcttagtggaccctcgggtgaggtcgcgattgcgcaaatcctagagacctccacctgtagatataaaaatcactgtaaggttctcatggacacaaaaaatcactgtagggtactttacgaccagtaacccatccaaatcttttggcaagaagacccgttgtactacaaagtcgtgacacctctcacggtgcaaagggtggtatgtgtctggtgagtgacggggaagtcgattcgggtcgagacacgacccactacttcttttcaatccccaagggaccaccttcccccacgattttcacttcccgngaaataggggtcgataactcggactcggctctctttgaaaccctgaggctcgacgtaggtcttcttttttgaggtctgagaatgaaccccgaccctggggttctggacgaccgtcgatcggagtgacgacaggaggaccctcccacctaagagaaacactactccgtccatccgggtggcgggactggagtccagatagacccctcttgcgacgaagaggagagactctggtgagtcgttgagagagggagatgggtcgagactaaaacgggggacggagggagggtcgtcgaggggtccggggacgctagaacgagacattcaagtacg

SEQ ID NO: 1655 - DNA, 661 bp, Homo sapiens
  LOC388226
  misc_feature [331]..[331]: Chromosome 16, SNP identification no. = rs11074570
  misc_feature [331]..[331]: allele = g, in linkage disequilibrium with rs26764, respectively
  misc_feature [331]..[331]: n is a, t, c or g
tcggagtcccaaagtttctctcggctcaggctcaatagctggggataaagggcccttcacttttagcacccccttccaccagggaacccctaacttttcttcatcacccagcacagagctgggcttagctgaaggggcagtgagtggtctgtgtatggtgggaaacgtggcactctccacagtgctgaaacatcatgttgcccagaagaacggttttctaaacctacccaatgaccagcatttcatgggatgtcactaaaaaacacaggtactcttggaatgtcactaaaaatatagatgtccacctccagagatcctaaacgcgttagcnctggagtgggctcccaggtgattctgatgagcaaccggatttgagaattattgctctaggccatggctgttccttctaaccttgagctacttactagtgattttggtccaaacctctcccaggagcacatgcttttatagtttttgttttcaatgaatattttacaatttttacgctgaagaagaataaagaaaatgtgacctatgtttcatgatttaaatagtcaatgtcttttttttttttttttgagacagggtctcactgtgttatacagtgcagtggtgtgaccatagctcactgcagcctcaaactcttgggctcgagcaatcc

SEQ ID NO: 1656 - DNA, 661 bp, Homo sapiens
  misc_feature [331]..[331]: Chromosome 17, SNP identification no. = rs1963296
  misc_feature [331]..[331]: allele = g, t
  misc_feature [331]..[331]: n is a, t, c or g
taggaatgtgggttaagcttcccctatcagtacccagtaattatgaaattccaaagttctaattagtatgacagtgaaatcctacgattccctactatagctaaaaatggttttgctcttaagatctaagtcacagtatttgggaagcaaatgaagaggtcaggttgtttccccagaattagcgtcagattggcagaggatggtcaagtgatatgaggggctgcattttaatcatctacaacagcacataaataattcagacctccatgagttgcttttccttagacaagaataccttaaaaaattccatccctcctatcaatattgcaancctatttttaagcctgttattccccagaaatactccaatttcttttttctaactcagaactttccaaaagtaaagtatctatcaaaagaacatctgagagtataaagttggtccctctttcaaaggggaatcaaccaaaattgggaagaaatgaagcgttgagtaagtcctgttttagatgcaatcagatctagatacaatctgaaagatggaatttaaaatatttgggcaattcctcatccttatcttcatcacgcttggactggaggtctggctgatgcatgcagcacttaccgtccacaccaaaggaaatcccagatctttacagca

SEQ ID NO: 1657 - DNA, 661 bp, Homo sapiens
  misc_feature [331]..[331]: Chromosome 17, SNP identification no. = rs3886341
  misc_feature [331]..[331]: allele = g, in linkage disequilibrium with rs1963296, respectively
  misc_feature [331]..[331]: n is a, t, c or g
atcctctcttcctctatcccacagaggccctgatgatgagagctttaatgatgtttagcaggtaggcagtgagaaatgattatatcacagagaagagaacaatttccaatctaatgtcaaacataattttataaatgtattagctacttcctaagagagaaaccctcctataggttgcatccctttatggaaccttctgcttcagtctctctatatcacggttctcagtctttgctgtgtgttagaatcaactaaagagcttccaaaaatcccagtgcacaagccttaccccaaaccaatgaaatcggaagcatttggggcgggatcaccnacattttcaaagctacccagttgattctagtgtccagccaactttgagaaccactgcttcagatcgttcttatatctgtctcttatcttttctcacacccttgaaggcttctctcccagagttcccaagaaaaccaaaaatttatctcattttattacaatgaatcagatcttttaggtatgtctgtatgtccatttatacttttggtctcatactaactcattcatgatgtgtgcatgggtcttcattttttccctcatgggtcggggtgggggagcaaaaataggctgaaacaaaaggactatttaccccaaagatgaattatgtcac

SEQ ID NO: 1658 - DNA, 661 bp, Homo sapiens
  misc_feature [331]..[331]: Chromosome 17, SNP identification no. = rs11869275
  misc_feature [331]..[331]: allele = g, in linkage disequilibrium with rs1963296, respectively
  misc_feature [331]..[331]: n is a, t, c or g
acaatatgtgcaaatactttgcctttctcatatgtttgagtaggtttaagattatttctattaaaaaaaaactgtctgttacctatattccaatatacttcctccaacctgaaagaaagtcacgaagttacagtgaaatcttgggagtccggcacagcatagtgtagacacacggtaatgggttacacatgccatccatcatgtgtgtaggggataattaatgaggtaacagtcagttaagttccagaagacttcagtgaaaatcacatgaatgatcaccttctttgcacacaagctgtttctttgtgtgggttaagatttctacacctangaagttgtattctttgtcctttccaatttaatagtaatttatcccttgttctttgagatgttgtgtacctcactggggggtttgggtatggctctagaacaaaatcactgattaaattttcactgagttcaatttattaccaagtacatctttcccagtctaaactgtagccaatagaaaaagactacataattagaactaaatatttcttgatggaataaatgaatttctatggcatataacatacaaaatgtggctgggcacggtggctcacgcctgtaatcccagcactttgggaggccgaggcgggcagatcacgaggtcaggagt

SEQ ID NO: 1659 - DNA, 661 bp, Homo sapiens
  misc_feature [331]..[331]: Chromosome 17, SNP identification no. = rs7212267
  misc_feature [331]..[331]: allele = a, in linkage disequilibrium with rs1963296, respectively
  misc_feature [331]..[331]: n is a, t, c or g
ttctgagtagagtaatctctgggcccctcttcccttcttcaaccagaatagttttgcctttatctgctttacatgttgaacttctcagtgagagcccatttgtaggaaatctacctgttggtgcttacagaaaagaaatagggagaggaaagaaagaagaaaagaaagagagaaggaaggaaggatagaaggaagggaaggagggaggaaaggaagatagaaggaaggaaggagggaggaaaggaaggaagaaagaaaaccagtagcccacagaatcaagtcttaattctcccaccttaatcctcccatcttgatcctccatattcattcnactttgtctccttttattaactccaatggaaatcttctgcttttgcctgactgggtctcttacccatttctcaaaagactattcattaccaattttaggctttgactctcacacttcttttttttttctttttggcctagaatgtcccatctcccttgaccttttctaagacaactgtaggccagtgctatttctggatcaaggtagagaggtctagtcttgcctctagaaaacagatgaaggtggcatcgggtgtcatttcatttaaatgcacaaatgcacacataaaagcaaatgcatgcacacacacatatgtgcatatatgcacag

SEQ ID NO: 1660 - DNA, 661 bp, Homo sapiens
  misc_feature [331]..[331]: Chromosome 17, SNP identification no. = rs2188894
  misc_feature [331]..[331]: allele = g, in linkage disequilibrium with rs1963296, respectively
  misc_feature [331]..[331]: n is a, t, c or g
ttttaggctttgactctcacacttcttttttttttctttttggcctagaatgtcccatctcccttgaccttttctaagacaactgtaggccagtgctatttctggatcaaggtagagaggtctagtcttgcctctagaaaacagatgaaggtggcatcgggtgtcatttcatttaaatgcacaaatgcacacataaaagcaaatgcatgcacacacacatatgtgcatatatgcacagatatatacagtaacttaatatgaaaacccttctataaatgactttatatgtataaatttatgtgtaaataatgttatttaatggagataaatnaagatgaaaagataccagaaaccatttagaaggagagaggaggaatgttagtagcatttattaagtgcctcctaggcattagtctcatgactttaacctcatttaattttgaaagtaaccataagatgtaggagtcatgagcctcatataaccagtttaatgaggaatctaaactctttgtaggacaaacttgaaacagttttattttttctaattatcttgtcaaccacattctctattctgggcagtggggatgtttaatgacatctcagcttaactctctgacttttcggtctcttggttttttgaagtgtctcatttgggttcttg

SEQ ID NO: 1661 - DNA, 661 bp, Homo sapiens
  misc_feature [331]..[331]: Chromosome 17, SNP identification no. = rs2214260
  misc_feature [331]..[331]: allele = a, in linkage disequilibrium with rs1963296, respectively
  misc_feature [331]..[331]: n is a, t, c or g
ttctttttggcctagaatgtcccatctcccttgaccttttctaagacaactgtaggccagtgctatttctggatcaaggtagagaggtctagtcttgcctctagaaaacagatgaaggtggcatcgggtgtcatttcatttaaatgcacaaatgcacacataaaagcaaatgcatgcacacacacatatgtgcatatatgcacagatatatacagtaacttaatatgaaaacccttctataaatgactttatatgtataaatttatgtgtaaataatgttatttaatggagataaataaagatgaaaagataccagaaaccatttagaagnagagaggaggaatgttagtagcatttattaagtgcctcctaggcattagtctcatgactttaacctcatttaattttgaaagtaaccataagatgtaggagtcatgagcctcatataaccagtttaatgaggaatctaaactctttgtaggacaaacttgaaacagttttattttttctaattatcttgtcaaccacattctctattctgggcagtggggatgtttaatgacatctcagcttaactctctgacttttcggtctcttggttttttgaagtgtctcatttgggttcttgaaagtcagttctgtttatttaaaaccttccatc

SEQ ID NO: 1662 - DNA, 661 bp, Homo sapiens
  LOC342618
  misc_feature [331]..[331]: Chromosome 17, SNP identification no. = rs10512472
  misc_feature [331]..[331]: allele = c, t
  misc_feature [331]..[331]: n is a, t, c or g
ttgagtttctccttatacatgagtttgtcctttttaaaaaattctgaggccaatatcctcatatcttcctcttcctgaatgcatctattgagaacctgctgaggatgcaacttcttcacccttggtcttcctctttgggctctaaaccccttctctctgagaagctccagggcactgctagcactcaagttgatagcagaagtcacatctctccgatacaaattggagcgcaagctgcaaatccttagtggaaggctgaaaacatctgggctccatgacttcacaaaaatcaggagattgtgcccctgctgcatgtagtcaaggtatttcngtgaacctgaaggaaggagcttttgaaaagaagtttccaaatcctgtcccagcccatggcattggtaactataggttttatcatcaatctctgctttgatcacaccacctccagaatttaacagtgcacatatagcccggataattctagaattctcagatcttttcaaacagctgttggtcatcttcttcctgttttcttctccaaaaatcactctgcccacatctactattacctcaggatacggcatttcagtatcagtcttgagactctccatttcagcagcccctctgtgctccaaacaataaaagaaaggagttcctataatca

SEQ ID NO: 1663 - DNA, 661 bp, Homo sapiens
  misc_feature [331]..[331]: Chromosome 17, SNP identification no. = rs12940584
  misc_feature [331]..[331]: allele = c, in linkage disequilibrium with rs10512472, respectively
  misc_feature [331]..[331]: n is a, t, c or g
ccagggtctgacctcagggagtgaatgaggtcgtaatgagaaaatgcaggggtgaatggaaaaagttaaacttagcacttctaagagactgagcttcatttccacatatcatacatgtaccttcagcgctggaaaattgtgtgtgcaaagctctgtttttattttaaattaggcttcctgtacatattcattgtgggcaatattaacctatttcattacctcctaaatggcttgttcttttctatttatttttattctttttcctacttttcatctttgttaaacacaagacccagcctagaaaaatcctcatagattaggagctggcaanccctgggtaggaggattaaaggtaattttttaattaatttatttttcttccctttattatctttaactgatctgtatttttaatggtttacaatgagtataaattgtttttcataattaaaaaacaaatggtaaaaaccaacagatgggctgggtgtggtggctcatgcctataatcccagcactttgggaggcctaggtgggtggatcatctgaggtcaggagttcgagaccagcctgaccaatatggtgaaaccctgtctctactaaaaatacaaaaattagcctggtgtggtggtgtgtgcctgtaatcccaactactggggaggct

SEQ ID NO: 1664 - DNA, 661 bp, Homo sapiens
  misc_feature [331]..[331]: Chromosome 17, SNP identification no. = rs11655098
  misc_feature [331]..[331]: allele = g, in linkage disequilibrium with rs10512472, respectively
  misc_feature [331]..[331]: n is a, t, c or g
gaaactccatctcaggaaaataaataaataaataaataaataaataaataaataaataaaatcagccgggcgtggtgacgcctgcctgtaatccaagctgctcagaaggccgaagcaggagaatagcctgagcctgggaggcggaagtggcagtgagccgagatcgcgccactgcactccagcctgggcgacttgagtgagaccctgtcacaaaaaaaaaaaaaaaaaaaacccaaaaccatttcttcccgcaatcccagggcacacacactataatcctgcctcaaatgctcattcccagttatgaaacagggtacaggcaaaaccactntgcctaacagtcaccccgacggccgacggcgaggaattgtggagggggcgggggagaattgctcagaacttggaaagcgactggtctctcaggatagagaccgcgacgcaaagaagtgacggaaaagatgcgtccgccatcccttttgctccacccctgacgttggcctcggccttcgattggctgctcctcccaccagccccgcctcaggggcgcccacgtgacccgatggccgccgtgggattggttgttcggcgagagccgcgctaggctgtaagacctgagccgggcggagaagcaaaggagagggaagctggaagcacctttggc

SEQ ID NO: 1665 - DNA, 661 bp, Homo sapiens
  PEX12
  misc_feature [331]..[331]: Chromosome 17, SNP identification no. = rs1037590
  misc_feature [331]..[331]: allele = t, in linkage disequilibrium with rs10512472, respectively
  misc_feature [331]..[331]: n is a, t, c or g
gacacagcattttgggcccacttactatgacaagaacggtggagaccgatacacaaaacaatggcgacacacaaagtaatacactcctcagtggttcgaacagggtagtgtccaataggttgtcttcatgttgtagactaatttgagatgaggggactcttgactttcccttagtacagaataggagtgttgttttcataacgcgacattacagtgtctcgaccaaagtcgtaccataactcaactgtgaagagtcggagttaagtattgatatacttgaaatttactaatatacctaaagaaattttcctatacgggtaaactaggattngaaaatcggacgagagatcttgggatgaatgtcaactggttcgacgaatttcatcttcctagtcctgaccgtcccctatactcccggtcacatctctaatttgtcttattactcatgtgttcaaaaacggatagggaaaggaattttatattctttatttcctcgagaatgctttttgggtccaatctggcgtattttttatttcacttgtcactccaccatcgttctgaagaaaaatcttttctttcgtaaatggacggacagacattccacctttaaagtagtcaaacgtttgctattctttacgtctgaacgagaactatctttacg

SEQ ID NO: 1666 - DNA, 661 bp, Homo sapiens
  AP2B1
  misc_feature [331]..[331]: Chromosome 17, SNP identification no. = rs11656872
  misc_feature [331]..[331]: allele = a, in linkage disequilibrium with rs10512472, respectively
  misc_feature [331]..[331]: n is a, t, c or g
aggtgggcagaatatcatgtaccccgtggaaacttattaaatattcagtggtgctaagaatatggaatggctcaaagggaaaatgagttctaacttacaggcgactccagtttgaggcagcatctctatgctaatgtaaattctttaatgcagaacctatacagttagatggtcagggataaggcctaagggatgtttagcagtaaagtcgtgtgtgtgtgtgtgtgcgcgcgcgcacgtgcgcacacacactcaagtagcacatttagagatctttatccagataaaccgagaagaataaaatgattctggaacaagcttagtttgtccnatttattcaaagtttacattgcaaaggagagagctagttttcatctagtccataaaatcaggtggcatacgtatgctatttatgtatttgtgttttttattgtgggaatcttcaaacattcaaaattaggacaaataaatgaatacaataaataaaatgaattcatttatcatcactagattcactagtcatcaatacatgccaatcttgttttacttattttctttccccatcccctagctatataaaatttaagcaggcagcacatgaataggtctctatttgaatttagtatatcataatattatagtaaactgtatagtgttctta

SEQ ID NO: 1667 - DNA, 661 bp, Homo sapiens
  AP2B1
  misc_feature [331]..[331]: Chromosome 17, SNP identification no. = rs17669281
  misc_feature [331]..[331]: allele = g, in linkage disequilibrium with rs10512472, respectively
  misc_feature [331]..[331]: n is a, t, c or g
gcatgagccaccgcgccctgccaaaatacctcattttttagaggaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaanagtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagagacaaagtcttgctctgtcgcgtaggctgga

SEQ ID NO: 1668 - DNA, 661 bp, Homo sapiens
  AP2B1
  misc_feature [331]..[331]: Chromosome 17, SNP identification no. = rs17606150
  misc_feature [331]..[331]: allele = t, in linkage disequilibrium with rs10512472, respectively
  misc_feature [331]..[331]: n is a, t, c or g
cgccctgccaaaatacctcattttttagaggaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaaaagtgctttacaancatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagagacaaagtcttgctctgtcgcgtaggctggagtgcagtggcaca

SEQ ID NO: 1669 - DNA, 661 bp, Homo sapiens
  AP2B1
  misc_feature [331]..[331]: Chromosome 17, SNP identification no. = rs16971217
  misc_feature [331]..[331]: allele = g, in linkage disequilibrium with rs10512472, respectively
  misc_feature [331]..[331]: n is a, t, c or g
aaattgtgtttagtcacttccttttataatgcatcagtctactctgtttgaaggtagctcgaaaacagaaaagtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccntaataataacaaacacatatccttttttttttcttaagagacaaagtcttgctctgtcgcgtaggctggagtgcagtggcacaatctcggcttactgcaacctccatctcctgggctcaaataattctcccacttcagccttctgagtagctgagagtacaggcacatgccatcatgcctggctaagttttgtatttttagtagagacagggtttcaccatgttggccatgctggtcttgaattcctgacctcaagtgatccgcctgcctcagcctcccaaagtgctgggattacaggcgtgagtgagccaccatgcccagcagaaacat

SEQ ID NO: 1670 - DNA, 661 bp, Homo sapiens
  AP2B1
  misc_feature [331]..[331]: Chromosome 17, SNP identification no. = rs9897552
  misc_feature [331]..[331]: allele = a, in linkage disequilibrium with rs10512472, respectively
  misc_feature [331]..[331]: n is a, t, c or g
aattctaaagtacatgtgccttaaggactgcatatataggttaaaatttaacgtttaagttacatataaaaaaatgtgggagagaggagttgcttccctgacctgatattttgagaaacttgtattctgctcttttaaaaatatcaacttgtttttgttttataatgttcaagctttgttttcaaatgaagatctaaatgaggaggtttcaggctgctatttataaacacttaggagcaaattagtccctcagtgccccccctccccacacacacacaaacaaaatcaactaaattagatataattatcactgtttcttttttttaacccnggcatttcaaatactagagacattttgataagacattcatatgtatacatatacatatacacatacacacatttctattagaataatgcaagttataaatgtaaagattatcttgagataaaatttactgttttaatattttattaatttgctgtattgcaatgttctatatgcttttcgtctttaaccaccaatccattatgagtgcaatttaaacaatctgtgactgagaaaaaccatttaaatctatatagtcaaaaacatcagggtaactactgctattgaactggatgataagggccttaagtggctaaatcgtgaatcaattca

SEQ ID NO: 1671 - DNA, 661 bp, Homo sapiens
  AP2B1
  misc_feature [331]..[331]: Chromosome 17, SNP identification no. = rs12943224
  misc_feature [331]..[331]: allele = g, in linkage disequilibrium with rs10512472, respectively
  misc_feature [331]..[331]: n is a, t, c or g
atccgtccaccttggcctcccaaagtgctgggattacaggcatgagccactgcgcctggctggccctgatgattttttatattttttgtagaggcaaggttttgccacgttgcccaggctgatctcaaactcttgggtccaagtgatccgcctgtttcagcctcccaaggtgttgggattacaggcatgagctatgagctaccacatccagcctgaagtatcttcttaatacccagtctgcataaatcactacaacattggttgatgataaatccagcagtttgggtttctgtatggagaacagtttcatctccacctccttgcctttgcnttttctttaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggaggtaagaaggtgtgaactgtctctgagtgagaaatgactcttgtttagacagcgttgctct

SEQ ID NO: 1672 - DNA, 661 bp, Homo sapiens
  AP2B1
  misc_feature [331]..[331]: Chromosome 17, SNP identification no. = rs11652390
  misc_feature [331]..[331]: allele = a, in linkage disequilibrium with rs10512472, respectively
  misc_feature [331]..[331]: n is a, t, c or g
agaatatcttcatgttacttatattaacattattgcttctattaagtaatagattagtccaatctgttagtaatagattagctcgctaatcttagcatttagtgctcaatgaatttttacatatgtatacactcatataatcactaccctgatcagatatagaatattttcagcaccctagaaggttcctcgtgttcctttactgtcagtgtgcacactccagagattaccactgttctgatttctatcactatagattcattttgtctgttcctgagtgtgctataaatggaacctacagtttttactcttctgtgtcttgtgtcttttnctcaacataatgtgagattaatctgtgtttttagtagtttgctcctttttattggtgtgtagtattccattccatgaatataccatttatatcttctattgcacctttgggttatttctagtttgtggctgctgtgaatattcttgtatttgtcttttggtagacttatgtatatatttctcttgggcatatacctaggagtagaattgctggatcatagaataggtttctaattagctgtaggagacactgccaattttccaaagcagttgtaccagtgtatactctttctagcactgtatgagttccatacatctatctacattgtca

SEQ ID NO: 1673 - DNA, 661 bp, Homo sapiens
  AP2B1
  misc_feature [331]..[331]: Chromosome 17, SNP identification no. = rs3506
  misc_feature [331]..[331]: allele = c, in linkage disequilibrium with rs10512472, respectively
  misc_feature [331]..[331]: n is a, t, c or g
acagtggaacaatctttgcgtctgagatccagagtgaggtctggttgatttagtagagaacgtccgagtcacacgaccgagtgtgtggacattagggtcgtgaaggtctccggttccgtccccctaacgaactcgggtcctcaagttctactcggatgcgttgtatcactcttgggtaaaggtgtttgatttgttttgttttgtttgggagagaacatgttttagaaatcctctaagttccatatattaaataaaactcttcgtgagacattccgttcctacgtaagttttttaccgaaactcctaattagaagagaaatccattaaacgnattcttgttattttcgtaaaattttcaggtgacggcggaatctttgagtagaagaaggtgtgtccgtttaaatccagaaggaacactacaagagctttttccttggaactaagagactcacttatatataaattggtgtatgcctaggtttcgtttttattcccgaaattaaagaagagtagaactaaagaccctatagaaagttagagtcttattcgacttcttttgacgtgacatttgttaaagaccccgacattgtggttcctatggtaaaatctagggtttcagtcctttacaattttaaatctcaatgtatttttgtattgaccc

SEQ ID NO: 1674 - DNA, 661 bp, Homo sapiens
  AP2B1
  misc_feature [331]..[331]: Chromosome 17, SNP identification no. = rs11654542
  misc_feature [331]..[331]: allele = a, in linkage disequilibrium with rs10512472, respectively
  misc_feature [331]..[331]: n is a, t, c or g
tcaggaaatacttatcaatttattatttatttgttgatatttctagtcaggaatgttttgccacaacattcctgaaagctgtggccttcctccatcaatagtagtgactctcaacattggtgattctttaaagaggagtagggtgggccattgctgtgatataaagaaagtaaacatactgtagctccccaggtgattgattcttgtatgcttttttaaagaaagcagacatctttgaatggaatgcctcttcatctcaagacttggataaaaatggatttctacctattctttttagtctccttactgaaacatccttatttttttatcncatttcagcatattctcttttgcttgtactctacaggtagtttattccatctgtcagtacaaactgaactatcgctttgatgtggagtaaattcaagtaatgtagtttatgcagttgatctgctctacatgtagagcatgacagtttactagttaggtataggcttgcttgcaaagtagttatttgggctttttttgtttcctttggaagccatgtatgtggagttttttgggtttgggtttgtttttttttttttttttttatgactctggtacttaatctaagaaactgctcgttctgagtagtgtgatttttctcaccgtgcagatc

SEQ ID NO: 1675 - DNA, 661 bp, Homo sapiens
  AP2B1
  misc_feature [331]..[331]: Chromosome 17, SNP identification no. = rs17670584
  misc_feature [331]..[331]: allele = c, in linkage disequilibrium with rs10512472, respectively
  misc_feature [331]..[331]: n is a, t, c or g
tgtgtgttctcatcaatgacgaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggatangtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaatctagtgaaaatctagtggtatgtagtgcag

SEQ ID NO: 1676 - DNA, 661 bp, Homo sapiens
  AP2B1
  misc_feature [331]..[331]: Chromosome 17, SNP identification no. = rs17670614
  misc_feature [331]..[331]: allele = g, in linkage disequilibrium with rs10512472, respectively
  misc_feature [331]..[331]: n is a, t, c or g
gaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaatctagtgaaaatctagtggtatgtagtgcagcagcaggagaaaaaaatgcagagaagtcatttctcttattcctctttccccattggtattacgtatggattctagaatgccactgctcagatgtggttttcatggattttagtgtacctttttagagttccantttaggtttgtgtcactggggctcttcttgtcttgtcttaaccttacttgatgtcactcacattgaagttcaagaggggaaactcccggttaatgaagctcatttaagcccttgggaaaagcaccatccaggctaggccaggcttcatacagtcttacctttctgaggaccaatttggctgaattctctgctttctaatctgactccttatgggggatccctgctatagagatgtagaccagttgtccattccaggagttgtaactgtgataactgagtgtgtatagttattacagtacatagcaaaaccgaagatattcaaaattgagc

SEQ ID NO: 1677 - DNA, 661 bp, Homo sapiens
  AP2B1
  misc_feature [331]..[331]: Chromosome 17, SNP identification no. = rs9907772
  misc_feature [331]..[331]: allele = a, in linkage disequilibrium with rs10512472, respectively
  misc_feature [331]..[331]: n is a, t, c or g
tggctcactgcaagctctgcctcagcctccccagtagctgggactacaggcgcccgccaccactcctagctaatttctttttgtatttttagtagaggcggggtttcactatgttagccaggatggtctccatctcctgatctcgtgatctgccctcctcagcctcccaaagtgctgggattgcaggcgtgagccaccacgcctggccttaaatttttttatctttatttttttaatagtataggccaggtataccacaggttccaggaccaaggggcgtgttatgaattatttaggtagataaaaagaataggcattcagattatatgancaatatctgagtatttactatttaccacaaactatagcaagagttaaaaacgtatataagacatagtcgatgcctttaagggaattaccaataatggctttggttggaaatgatgaaaaaaaatcttcaaagattacagccatgctgttttcattagtagatgcagtttcttccctttaaaccattttaccaaaactaacagaaaaacacattatgctcattggaatttttcttttcctcttggtagcagtacttaaaagtagtaaaataaccaagctgaacagaaggtagagcagaagccagggtcgtttaaagactggttttttaaaa

SEQ ID NO: 1678 - DNA, 661 bp, Homo sapiens
  AP2B1
  misc_feature [331]..[331]: Chromosome 17, SNP identification no. = rs17676508
  misc_feature [331]..[331]: allele = t, in linkage disequilibrium with rs10512472, respectively
  misc_feature [331]..[331]: n is a, t, c or g
taatccgcccacctcgacctcccagagtgctggaattacaggcgttagccaccacacctagttgtttatatgaaataaaatgtcttcctttaggttctatctgtagatcctagttctacattttgagatttttataaattaagtttctgaatcaaggcacccagggcctgaaagtcaatcaggtgggcctgtaatgaaaacatactccgtctgaatttattttcttttttttttctacttaaggaaagcctaagtttatggaaaggcatttatataatgtcagttttattgttctaattttagaagaaaatccatttagaaggagggaccntggtaaatgtagttggaatcagttatagtttggagactgaaggaaaatattatctaatcacttttgaaaagtgtgtgaatgaaagatgatccttgacttggtagcagtcttcctttccaggaacccctgaaggagttgaagggcaagtactcagaacaggaaagcacagaacttctcgattccatagctcccactgtgctcctgacagtaatatgtatatgtatatgaccttcttccccagtggaactacccagagacagcatctgtgttcagtggcctgcccatctgtccagtcatcttgacagtcacgtgtcctccttttgtccacgt

SEQ ID NO: 1679 - DNA, 661 bp, Homo sapiens
  AP2B1
  misc_feature [331]..[331]: Chromosome 17, SNP identification no. = rs17608253
  misc_feature [331]..[331]: allele = g, in linkage disequilibrium with rs10512472, respectively
  misc_feature [331]..[331]: n is a, t, c or g
gttggcttcctttcgaatcaaggctttactaagagagattggctcttaggagctcattgcctttttaaagcccaataattatatgtgctactagaggatttacaattttagagatcatctggagggctctgttcaaagctttcatttctggttctgagaactgtttaaatatggaaacttcaaacgctgaagtgcatattagggacatggaaccactgcctaatctgtcaaattttccctataaagggttccactgttcacatactcttaacgaacaatgtcctaatgtctcctgagaataaatcagtatggctttatactcaggatgaanagcagtttggtaccatttgaggcctcctcagctatcatgtaatacccctgatctattgggtggactgagaaagaatatgggaagagagttcttgtttgaatcctagccttggaagtgaactaaagacgctgtccagtttaaaatggaattagcactggaaggaaagtcaattgacatttcctgtggttcattactctttctgctatgtttttaactctatcagatactgtctaatatcataaatagacctttctgttttgtcagggtctctgagaattcccagataattcattggtcaatagagtttgaaatgctatttaaactttgggt

SEQ ID NO: 1680 - DNA, 661 bp, Homo sapiens
  misc_feature [331]..[331]: Chromosome 18, SNP identification no. = rs10502692
  misc_feature [331]..[331]: allele = t, in linkage disequilibrium with rs10502694, respectively
  misc_feature [331]..[331]: n is a, t, c or g
cttcaaatccaaaacaaacacagaaaaaattttcccccctttcccttgcttgtgagaactgacaaacaagaggttaaaatatgttttatgttccaagcaataaatatttactgagaaatcaagattaataagttctcttctcctcatggtctagaaaaataaaatatggacttttatccaattcagttccataagcaggtataaatcacctaccatttacaggtattgttctacctgctaagaaataaacccaaagaggacactttcccaccttcaggagacttccctgtgggaaagacagacaggattctacataagaaattccattttngttggtcaaaagcatcagaacatgatacatcttatacaattcagtctaatttaggggcaaggttttttttttaatatttataggattatgtaactttcagccaaggcttcctacaggaggtggtatttgagttccattggttaaaagagggaaggatatgccagaggaaattccttaaacaaatgcctaaaataaaggagtgacgtggtatgtgaaggagattactaaaactccaatataattctttaaaataattacatgaggcagagggtctggggataattccagaagcatcagtaggacaaagacatggaagactttgtatgtcag

SEQ ID NO: 1681 - DNA, 661 bp, Homo sapiens
  misc_feature [331]..[331]: Chromosome 18, SNP identification no. = rs12373278
  misc_feature [331]..[331]: allele = t, in linkage disequilibrium with rs10502694, respectively
  misc_feature [331]..[331]: n is a, t, c or g
ttgagttccattggttaaaagagggaaggatatgccagaggaaattccttaaacaaatgcctaaaataaaggagtgacgtggtatgtgaaggagattactaaaactccaatataattctttaaaataattacatgaggcagagggtctggggataattccagaagcatcagtaggacaaagacatggaagactttgtatgtcaggcttgggctttcttctgtagattatggggaggccagggaaatttttaaattactggagtgactgggtcaagcgtcgcatgttggatgaatcattttggctctgccgtcacacacatacactgtcctntgccagggaaccccttcagtctgtactttccaggcctcttgccatcttcacctctggctgggtcttgataatggaaggcactgataagaggttgagttattcagatgaaggaatagttggtgaatttagcccttagtctctccatgcttgcccacacattatcaatgattgttcctctgtggtcatagcatctatcgcactttctccagcacctgctatcaccagaatcctttagggctggtactggcttcctgaagttcctagtttggctccatcgtaatgcattttttattttcttagccctctgctcacctctgagaatgatctttt

SEQ ID NO: 1682 - DNA, 661 bp, Homo sapiens
  misc_feature [331]..[331]: Chromosome 18, SNP identification no. = rs9954810
  misc_feature [331]..[331]: allele = g, in linkage disequilibrium with rs10502694, respectively
  misc_feature [331]..[331]: n is a, t, c or g
attgctgccttaactaataagtacaaaatgtcagaaatttcatgctttcttttgtggatattcccaccactgttatttgtaccattgattcgattgtgttgctatagagagtttcattcctgcaacaaaacatgttgaccacagctacaatgttggaaagacctaagtttatgggtgtgaagagaaggcacgtgtggaattccattcattgggacaccagttagaaaacttggctggtgaaattattggggacaggataagctccatttctcagaggagtgaaaggttcatcagaaatctctaatattgctgcttgcatcttgctgagagntatttatctaaaggcatttttgtaattgctagaattaaaactgattacatttcagaaccagttttcagcctttatttctgggttaacttttatagacagcggtgtttgtgaccatgttctcaccatgcttgatggcctttcattccttcctcactggggtgactgccacctgaagttctccgaggacattgccaaactatattcccactgcttcctttaattttaatggtaagcatggcttcttacctgaaaaattcatactgaatattttatttttagaacttctggttgtagggaagggacacccaattcaagtgttaaagccttata

SEQ ID NO: 1683 - DNA, 661 bp, Homo sapiens
  misc_feature [331]..[331]: Chromosome 18, SNP identification no. = rs10502694
  misc_feature [331]..[331]: allele = c, t
  misc_feature [331]..[331]: n is a, t, c or g
tcatgtagtcattcactgttttcaaagttgtttcttctagattatctcactatgtcctaaaataatacttatgaatgttcgtccagctggctactttaatttccatcccttagagtcagtggtgacctggctgtcaattggtacaggtctgtccagttcctgtcctggatctgcccagttagttgggaaagactcaggacaggagccctagaccttcaaatcttaggtattgatctcttcccagggcagcacctcattcttatgggatgggcacaccaatgggtgcctttttctttccaccacacagagcctcgctcacaggaggaccatnacgaacacttgattgaatgaattttctactcccaattgtagtatttatcacttgataaggaaaataaggactttaatgccttttgtttattttccaaccacttattttctgctttacctaagtacatagtgtaagtttaatataggagaaaatgtgacatttaggtaatggacataataaaaattttcacgtgactacctcattattataccagcttcaaactaaaattttctacacccaaaagggaaaaaatatgtgattgtaaaggttactatttctatttaaagtgtggatgtgtttaagcagctataacagttttctttaatgtgt

SEQ ID NO: 1684 - DNA, 661 bp, Homo sapiens
  misc_feature [331]..[331]: Chromosome 18, SNP identification no. = rs646985
  misc_feature [331]..[331]: allele = a, in linkage disequilibrium with rs10503122, respectively
  misc_feature [331]..[331]: n is a, t, c or g
gagaatgtctcaataacttagagaaggaatagacaatataacggaaagaatgaagttaaacgacacaaaagaaaacataactatcttatcaagtctcttggtagataaataacaaattcccaaaaacaatataaagaaaatcttcgatatctaattaaatgacacctaattgaataactatatttaaattgataaaattataggattcatttaaatgagtagaagtaaaaactaaagagtataataaacaagaataaagaaacggactttattgaataactaagttttattatgaataacttttagaaggtacttggtatatttgaaacgnactaaatttttttacaaattattaatctgataaattttaaacataaatagagataaatttagaagccgatttaaagtacataaaactataaatcttaatagtgtaaaagaataaaagaattatcacaactaacttatcgagaaaatagatgtcaaactataaataaatcttgtcatacactttacaaagttcgtacacataaaaataaacgatttatatcgttgagatatatgataaagataataaatattaaatattttaataaaataaccagaagatgtactaactaagaataccaaaaagataccaataacttaagagtttataact

SEQ ID NO: 1685 - DNA, 661 bp, Homo sapiens
  misc_feature [331]..[331]: Chromosome 18, SNP identification no. = rs17079646
  misc_feature [331]..[331]: allele = c, in linkage disequilibrium with rs10503122, respectively
  misc_feature [331]..[331]: n is a, t, c or g
aattcgataataaaagggaatgcagacgtccccagtattttctaggccaagttatgtgccaccacaggcatgacctgttaatgcagtattgcatagcatattgatggtttggaatgctatatctggtgtgtgtgtgtgtgtgtgtgtgtctgtgtgtctgtgtgtgtgcatgtctatgcgtgtgtgggtaacccaaccaatagagcatcctcagtgctagtgagaactgggtggtggtcaagcctctgctacagtgttacctccttaaagtgtcatttccatcacttttctatctaaaaatgtgccccgcctccatcagaaaagccttaantattaccagaaagcctgcctaaggccctcaattggaatacattctgttatattataattgcattgtgttctgaacttttttctccttatccctgacattttaaagaacatactgtgcttgcttacgtaataaagatatggtattagcttgcatgaagaaaatggcctttttgtctttagtgagattgtagtttctagtgaaagctatgattttatgtatgactgttgacattcttgcctctccaaggaatccttataagataaaatgtctctttccttttggtaatattatttcaaaaatagacttaatctaaaacagctgttgaaattg

SEQ ID NO: 1686 - DNA, 661 bp, Homo sapiens
  misc_feature [331]..[331]: Chromosome 18, SNP identification no. = rs631470
  misc_feature [331]..[331]: allele = a, in linkage disequilibrium with rs10503122, respectively
  misc_feature [331]..[331]: n is a, t, c or g
gtaaaatatattaaaagaagtgtggtcatacataaaaaaatttatcgtaatggacaaaaaaattctcttttaaagtagaccaactggtcaaacaatacatatcaaaatgggttattttaataaggaggaaaaggatgagacgtcaaaccctagttaaagttgtcgacaaaatctaattcagataaaaactttattataatggttttcctttctctgtaaaatagaatattcctaaggaacctctccgttcttacagttgtcagtatgtattttagtatcgaaagtgatctttgatgttagagtgatttctgtttttccggtaaaagaagtncgttcgattatggtatagaaataatgcattcgttcgtgtcatacaagaaattttacagtccctattcctcttttttcaagtcttgtgttacgttaatattatattgtcttacataaggttaactcccggaatccgtccgaaagaccattatcaattccgaaaagactacctccgccccgtgtaaaaatctatcttttcactacctttactgtgaaattcctccattgtgacatcgtctccgaactggtggtgggtcaagagtgatcgtgactcctacgagataaccaacccaatgggtgtgtgcgtatctgtacgtgtgtgtgtctgtgt

SEQ ID NO: 1687 - DNA, 661 bp, Homo sapiens
  misc_feature [331]..[331]: Chromosome 18, SNP identification no. = rs1676846
  misc_feature [331]..[331]: allele = t, in linkage disequilibrium with rs10503122, respectively
  misc_feature [331]..[331]: n is a, t, c or g
aagaaatagaatagagttaatcgaccgaggtgttcagaataaaaattctaccatttgtaggacctgaccattatgttaaggaaataaaaaggggttataaaatgtattgaaaaagaaagaaacaatatgagacactcaaagggatttatagtaaaagtcagaaagagaactcgaaaaatatcacgaaagtatcaaaattaaaggtcttcgagaaaagttcggactcacatagaaccaacaaaaaaacaaacaaacaaacaaaaacaaaaaaaatccatccccaccgtaagacaacaataaagaataaactttctagtaaagtaggtaaacnccaaaaaaaaaaatccaaaaaaagagagaaatatctaaaacgaacaaaattcaacaacataaaaataaacaattcaaacaaaacgagtaaagaatgatatccctaccccttcctaaaccgtatattcctttgtggttcagaatttttccgaaagtatattggggagacggagcaattacgtactttgttcgtaaattagaagggtccagggtcgttcttcggtcctcgataaagagttttttttttttccttactgatcaaaattttgatatctatagtactaaaaaaagagaatagtctcgaatagcgtcagaggagaggtgaatcgta

SEQ ID NO: 1688 - DNA, 661 bp, Homo sapiens
  misc_feature [331]..[331]: Chromosome 18, SNP identification no. = rs12458298
  misc_feature [331]..[331]: allele = t, in linkage disequilibrium with rs10503122, respectively
  misc_feature [331]..[331]: n is a, t, c or g
catcttaaaaataagacttgtggagccagctaattgagataagataaagaagaaaatgtttaacacaataatcaagaaaattttataggaacttaaagaaatgagttgccatatttaaaggattcattgggtgcttagctcaaagaatagacataaatacgtagcaagacaacataatattttagtttacctgcattaacagcatctagtggtcaaaggaagaagtagaggtgaagggaacaggtgacagtcacatacaaaggaactgagattaagaatcacatcagacttctcaacagacatatggggggccagaagacaatggaacaangtcttacaattttgggagatgatgctaagtatagaattctatacacattcaaattgtcaatcaggggtttgtacaaactaaaaatgttttagatctgtaaagtattcatttatttttataagtcctttctatcgaatgtagatttttgccaaaatgagggagtaaaccgaaagagaaaacaggatatccaatactcaagatttagggaagtctcggatggcagctggattgtagacctacagagcatccctgctataggggaccacatagatgcccacacttctgagagttctgcaggaacattcccctcagccctcacccctctttggg

SEQ ID NO: 1689 - DNA, 661 bp, Homo sapiens
  misc_feature [331]..[331]: Chromosome 18, SNP identification no. = rs17079657
  misc_feature [331]..[331]: allele = c, in linkage disequilibrium with rs10503122, respectively
  misc_feature [331]..[331]: n is a, t, c or g
gtgcaagctttaaattagaataccaccagtgtgaaagagatgaacacagttaattacatgactcagtaggtgtaagataaaaataaacctgctcctaaagaggacattgtattactttatttcaagaataaagagaaatttttctcatgagttattaaataaacacttttgttgtaccaggtgtcattgatacattcatttagccagtccttccaaagccttgtaattgtacaacaggagtcttcaaggactacacagtaaggtataagaaccagcaaaggaaagatataaccattgcccagtgtcacattgtcactataaaagcaaatgngtggtgctatgggaacccaaggaccaatgctaaagctgcttttagtatcgtaacagggtatccagtgaaagtgatgtctaaatttaggtctgaaatatgaataggagttagatgagtaatgagaagaaagaggcagaaaaccagtaaagtgcttgcagcaagaaggataacagcttacctgggtgaattgaaaacttttcaggatagctagatggcagggtttgcctaacctaaatttatcttcatcctggagtaagagcctcttaagtttattaagatacaatgtgcaggcaaaagaaaaaaaattcagcctcttttgcagcaaagtaa

SEQ ID NO: 1690 - DNA, 661 bp, Homo sapiens
  misc_feature [331]..[331]: Chromosome 18, SNP identification no. = rs679650
  misc_feature [331]..[331]: allele = g, in linkage disequilibrium with rs10503122, respectively
  misc_feature [331]..[331]: n is a, t, c or g
cctctaaatggagggagtacacccttctatggctttccttgctctgtgccgtggaacacagctgagtttgagcacgaagctcatcaattttcagccttaatttgtctttttatacaaatgtctaaggctacaatttccctctcaaacaaatttcatggcctcccacaagttacgatatgtattatttttattttctctaattatacatttttaaacattcgtctacaacttgcttagttgtgaaaaaagtctttatgtagtacttctttgaaatctgttggaagtttttcaatttttataaatattctatataagtttctggagaattcantttttaagttgctgtgtgaagcagtttctgttaactagtatattctgtttacgtgggtaatcaatcaatatttgagatatgttgaaatctcccactctgagtgtgaatttgtcaaattctcaattttaaaataattttttatttaaatatttgaatctatattattttctctctacacttttagaaattttgtaccttcctggtgaggtgaagattttattattttgttgcaaacttccttaacgctggcatagctttgtgctttaacatctatttttggatattatataactacactagattcctttaaacaatactttgtgttacagc

SEQ ID NO: 1691 - DNA, 661 bp, Homo sapiens
  misc_feature [331]..[331]: Chromosome 18, SNP identification no. = rs12604145
  misc_feature [331]..[331]: allele = g, in linkage disequilibrium with rs10503122, respectively
  misc_feature [331]..[331]: n is a, t, c or g
aaaagaaggctaacatatctcttataaccactttgtcctctatttacggagaacatatttgccttaaatgtattgttgtttgggattaaataatttattataactaaattttgaaatattccttgacactttttagcctaaaatctgttttttgttgttgtttgttttttgtttttggttttttttctgtccattatctccacactgaatacattcccactcactagtcacttagtggccatgtggattatcagatcgactgtcatggtattccagagcttgtgttcaggtaacccttgtttttcttaatgatggccttaaagctcaagantaagagtagtgatgatggtaatttagatatgcctaagaaaagccagaaagtaaaaaggtgaaagttctgtacttaataaggaaagaaaaaagcatcgtgtgtggaggttgtgaagattacaataagaaacaacctacctgtgatactgtgaagaaggaaaacagaattcatgctacttttgctgatgcacctcacactgtaaacgttactgccacagtgcatgataaatctttagttagaattgaaaaggcgttaaatttgtgggtggaaaacatgaacagaaacgtattctgattgacggcagttgggtttggtactacctgtggtttt

SEQ ID NO: 1692 - DNA, 661 bp, Homo sapiens
  misc_feature [331]..[331]: Chromosome 18, SNP identification no. = rs17079677
  misc_feature [331]..[331]: allele = t, in linkage disequilibrium with rs10503122, respectively
  misc_feature [331]..[331]: n is a, t, c or g
ttatagccccttttggaatcattctgtagatttgcttataccattatatacatcagtaacatttagcaagaacaaaaattaattgacattggaaaaagtggaaaacatttgcatcacggtgatttgtgtacagggttattagcatggcttctcagatataatcattacttaatattctatcaaccatatttaatataacatatatgattcttagacttattctgatgtaactcatactttttctttctttctttcttttttttagttttctagacccagctgatgcacatgtgtgactctcatgattgctagtgagattttcaaatgtaancattatctggaatgttatgtcttttaaggacatagcagttttggcttgttaggaaagactgaaaatccaattgaacaaaattttccataaaaaattttaaaacatattaattcataggagataagaattaaccatagatacattcaagtagcaatttaaggtgtcaattattttgattcctatttttgcaatgtctaagtttattcttaaatatcataatacatgtatctatctttctcttttcttagaatcatgcagtaaaatagagatgggtgattaaataactcctaggacaaagaagcaagattagaaatagggctacttctgctt

SEQ ID NO: 1693 - DNA, 661 bp, Homo sapiens
  misc_feature [331]..[331]: Chromosome 18, SNP identification no. = rs491835
  misc_feature [331]..[331]: allele = c, in linkage disequilibrium with rs10503122, respectively
  misc_feature [331]..[331]: n is a, t, c or g
atggaagtctatagcaatttacaatcagagaagaactttaaagaataaagttattgattccctgttgcataataggaattattaaaccaataataaaccaaggtctcctctgaaggcagcaaagacagatggatttcactatcatagggacagtagttattcccctaatgatagccttttccagggtttaactgcatattctgccagaggatactcttggtttcaccatttatattctaattttcagatcagaagagcagctggtaaatatcacttagaataaactttctatacttaaacatgtacagtcatgacattattctttgtcttnttccaggggtctgaagctgagtgccttattgatcttatattctcttattttgcattactgattactttcctatgaaacattgcacaatttataaattatttagcatgtaactactcaatagcaaattataatatttagttaccaaagtcaaaatcacagaagttcaatatagtgagatttgatatttttgtttaatgtaaattaaatatgtatgagcaaattatttttcttgcctcaaaataccatataagctatacttttaggttaaaactatataaatagatatatcaatatttatttcttattttatttaattaatatttattggat

SEQ ID NO: 1694 - DNA, 661 bp, Homo sapiens
  misc_feature [331]..[331]: Chromosome 18, SNP identification no. = rs12457185
  misc_feature [331]..[331]: allele = t, in linkage disequilibrium with rs10503122, respectively
  misc_feature [331]..[331]: n is a, t, c or g
acatactctcaacacgggattgcaaaactcactggcagctaggcaagaagactgtgagtagtaataaggaaggctatgagttaccaaaaaaaaaagcaagatctcttccaataatctgaaagtaattcttctggctaagatacacagaccgatgctaaaatcaaaaactgaggctgtagagatagaatgggaacagattatgttgatccttaaaggacatattgaactgtttggcttttctcctgaaacaaatgagaaagcactgaaggattttaagctgtagaacaatatggtcatatttgcattgaatatattaggatgaggaacagantagagaggaataggttgcagtaagggagtattccaggaggtgggtatagaggctacttcattagtccagctggaaaagatgatagcttggactaggtgttggaagcagagaccatatgaacttttctaaaaccttaaagaagagcatctccacatttaatgaaagatttgatcagatgactatagtggctcctctgcatacacctttgagggaccatgtgaatatttcactaagaggtaagaaatctcttgttaaagaaatcatgatttccttaagtttcttttgcttttaaatctccactagttgatgcaatacaagaaaaacaaaaca

SEQ ID NO: 1695 - DNA, 661 bp, Homo sapiens
  misc_feature [331]..[331]: Chromosome 18, SNP identification no. = rs12454555
  misc_feature [331]..[331]: allele = a, in linkage disequilibrium with rs10503122, respectively
  misc_feature [331]..[331]: n is a, t, c or g
ttgatccttaaaggacatattgaactgtttggcttttctcctgaaacaaatgagaaagcactgaaggattttaagctgtagaacaatatggtcatatttgcattgaatatattaggatgaggaacagattagagaggaataggttgcagtaagggagtattccaggaggtgggtatagaggctacttcattagtccagctggaaaagatgatagcttggactaggtgttggaagcagagaccatatgaacttttctaaaaccttaaagaagagcatctccacatttaatgaaagatttgatcagatgactatagtggctcctctgcatacncctttgagggaccatgtgaatatttcactaagaggtaagaaatctcttgttaaagaaatcatgatttccttaagtttcttttgcttttaaatctccactagttgatgcaatacaagaaaaacaaaacacctagttgtgtattccacatagtatcagtcagctactgctgcctaacaaacatttcaaaattccagtggcatacaaaaattagcatttatttcttatgtatccatgtgtcagttgatctagactaaatacttaatttcttttaagacatgggcttagaaataacaaggtgcaacttaccttattccactggataagacaagt

SEQ ID NO: 1696 - DNA, 661 bp, Homo sapiens
  misc_feature [331]..[331]: Chromosome 18, SNP identification no. = rs12455204
  misc_feature [331]..[331]: allele = a, in linkage disequilibrium with rs10503122, respectively
  misc_feature [331]..[331]: n is a, t, c or g
tgtaattttgtaaagtttttcttaaatctcaaagttgtaatatatcttgatgcataagagccaggctttgtagaagaaagaagaaagaattttctgtgaatttaacaagctgagttttacagatttagagcgaagctcagagtactcagcatggtgttttaaaccatcaaaggaagaatatttaatatggtaaaataccaaatactgcatcaccctgaaagaaacagaagttcaatcagtaggttaaaataaatggttctgcagggacctagattgatattaatgctgatagagtaaggagacctttcaactgagaagatagatttggggnattcccagatttgggatcttgtgcctgaccttccaaaatgcaacaggcaaaacaacataaaatctgtttacattatcaatggctgcatggtggtgtttaggtaaatggtcctgcaggcagctccatagttttgatacactccagggtgatgtggtcaaagcaaccaagacttcccaagccctgcaaaggggagaggatgttctttggagatacgttgggtcaggatgagaaaatgtagactatgtgactagtcaagataagaagctgtaagagggactggtgatacctgtggcatgtatcacttctaaacatgtaaaatcatcagggacg

SEQ ID NO: 1697 - DNA, 661 bp, Homo sapiens
  misc_feature [331]..[331]: Chromosome 18, SNP identification no. = rs12607604
  misc_feature [331]..[331]: allele = g, in linkage disequilibrium with rs10503122, respectively
  misc_feature [331]..[331]: n is a, t, c or g
tctggttaagtggtaagagggcaaatgaatgttacaaagttttaattcctgagacataaaccataaaaagctgaatataaaatagaagctagaaagttaagaaaggattcaatcaataccaccatgccctcaaaaacatgtcattagccataataatttattccaaacaaaggtattttcattcttggaaacaacattttcaaaactagaaaaaaaaaatgccaagtcaaaagaatcggattgagttccttcttttagaggatgtcaacagctgtaaataatttgcactccaaaagttataagaatgtgtctgagtgaaatagtataatantaacatggcagaggagcctgggagaaaggaaaggttaatttaatatgctctgaaatatccaagaagttagtttgcttcatatgcagtaaagagaagatcaagtttatctaaaatgaagtttttaaaaagttactcttctctgacttattttttccataacacagttttatttactgtacgtactggaatttataaaaaattaaatgactaaattgcctcgttatattgtaccctaatataaatgtattttaattgtaaattagtacttaaatatgattggttttgaagcactgcttaaaataattttatttgttaaaattgaatacaatt

SEQ ID NO: 1698 - DNA, 661 bp, Homo sapiens
  misc_feature [331]..[331]: Chromosome 18, SNP identification no. = rs595015
  misc_feature [331]..[331]: allele = a, in linkage disequilibrium with rs10503122, respectively
  misc_feature [331]..[331]: n is a, t, c or g
tcagtcacacattttacccaaaattgaaattttgcttgtgcttaagagtaaaaacatttgcaaaaatgtatgccttttctttcaatagtacctataatttgttgaagggttatgtaaaagtgatcataatatcattagtttaaaaatatgccatacaagaaacacacacacacaaattaaaaattaggcaggtggtttactaacattctgcaataggcacctttgaagttataatttttattcatactgaaattgttcctttttaatcttagtatctttcaatgggaaatgatattttgagacaactctgggtgttaggggttgtctttgntactggatttgtcactattcctaacttttttcacttaacaaaactagagtatataaatgtatatgtatatgtttataaataagtatagttttatataataattatatatgtatttatatacagtgcagaatggagtcacattgatgcttccattcaaaatcaggaccagggtttctattaaactcttcagtctcacatctgtatctcttttctccgtgttgcaaatcctggttcttgacaacagcaggaatggtagcattagcttatcatggtccacaaaatttctcatttgctttatctgtaatatacacacaacagtctcagaataac

SEQ ID NO: 1699 - DNA, 661 bp, Homo sapiens
  misc_feature [331]..[331]: Chromosome 18, SNP identification no. = rs607696
  misc_feature [331]..[331]: allele = c, in linkage disequilibrium with rs10503122, respectively
  misc_feature [331]..[331]: n is a, t, c or g
caggaccagggtttctattaaactcttcagtctcacatctgtatctcttttctccgtgttgcaaatcctggttcttgacaacagcaggaatggtagcattagcttatcatggtccacaaaatttctcatttgctttatctgtaatatacacacaacagtctcagaataacaatgtcaacactaccaccaagaatatgattacagaaaataactaaatattttacagctatttttgtcaaattattgtgatttaaataacttaggattattgatcactgtgtgtctacatgccactaactgaatacatgtttaagctcaattgcttagtttnattttagaattttagagattgatttatttttaatgtaattttacatggtctcaaagttgaaactacaaaagaggtaaaatcaaaatttaacttctattctttactcttcatttaataatcctaatagttgtcattttaaaatattatcatttacttttaattttaatatatattaataacataatcagtaccacttatacttttcatttgaaatattatagtttttccatttattttaacatattatacataaaagagttaaaatatatgctatatacatatttgtatatgtacacataatcatgtgttgcctttcttcttttctgtttt

SEQ ID NO: 1700 - DNA, 661 bp, Homo sapiens
  misc_feature [331]..[331]: Chromosome 18, SNP identification no. = rs12454311
  misc_feature [331]..[331]: allele = a, in linkage disequilibrium with rs10503122, respectively
  misc_feature [331]..[331]: n is a, t, c or g
ttacagctatttttgtcaaattattgtgatttaaataacttaggattattgatcactgtgtgtctacatgccactaactgaatacatgtttaagctcaattgcttagtttcattttagaattttagagattgatttatttttaatgtaattttacatggtctcaaagttgaaactacaaaagaggtaaaatcaaaatttaacttctattctttactcttcatttaataatcctaatagttgtcattttaaaatattatcatttacttttaattttaatatatattaataacataatcagtaccacttatacttttcatttgaaatattatngtttttccatttattttaacatattatacataaaagagttaaaatatatgctatatacatatttgtatatgtacacataatcatgtgttgcctttcttcttttctgttttttttttgttttgtcttttcactttgtattctagacatcactttatagtcacatatagaaatatccctcattcttttttacaactggagattatgttgatatgctactagttattcatcacttctaatattgacagatatttgtgctatttctaacatagacttttaaaataatttttgcaatgaatgaccttcttatacattttttgtattttcaccagt

SEQ ID NO: 1701 - DNA, 661 bp, Homo sapiens
  misc_feature [331]..[331]: Chromosome 18, SNP identification no. = rs11151464
  misc_feature [331]..[331]: allele = c, in linkage disequilibrium with rs10503122, respectively
  misc_feature [331]..[331]: n is a, t, c or g
agctaaatgatgaaaacacatgaacacaagggaacaacacacaccgtggcctgtcagagggtggagagtgggaggagggagaggatcaggaaaaataactaatgggtaataggcttaatacctgagtaatgaaataatctgtacaaaaaaaaaccctatgacacaagtttacctatgaaacaaacctgcatatgtacccctgaactttaaagttaaaaaaagacttattgatacacattgaaaataattatttctggttagtctcaaagaattctaatacataaactttttgtagtttttattgtattaccatttttttcccgcatttcantccttacatcctttgtggtacttatatattgtgtctctgtgtgtgtttggctgtgcagataattttccttggaattttacctataggaaatatttgtgatcttggttgaatttatttacatcagttccgtggggaaattttgaactcaaaaccatttaaaaataattttgctgagaactttttgattaagcaggtagcatgaagtagagctgcaaactcgtaacaggttcagcttgtgtttccatgttttaaaggactatttctcccttcaacactcaatacaagatcaagacgtacacatgtctttgctgtatctttcttctcagtagg

SEQ ID NO: 1702 - DNA, 661 bp, Homo sapiens
  misc_feature [331]..[331]: Chromosome 18, SNP identification no. = rs17079696
  misc_feature [331]..[331]: allele = g, in linkage disequilibrium with rs10503122, respectively
  misc_feature [331]..[331]: n is a, t, c or g
agacttattgatacacattgaaaataattatttctggttagtctcaaagaattctaatacataaactttttgtagtttttattgtattaccatttttttcccgcatttcactccttacatcctttgtggtacttatatattgtgtctctgtgtgtgtttggctgtgcagataattttccttggaattttacctataggaaatatttgtgatcttggttgaatttatttacatcagttccgtggggaaattttgaactcaaaaccatttaaaaataattttgctgagaactttttgattaagcaggtagcatgaagtagagctgcaaactcntaacaggttcagcttgtgtttccatgttttaaaggactatttctcccttcaacactcaatacaagatcaagacgtacacatgtctttgctgtatctttcttctcagtaggtgaattgatcattgacttttagtctcaagttatagttattttggatttccacttttatatgagggtctgtgctgttggagtcccacattgtcagtttctaggctttctctcctctctcttaggccctgagaagtcctcaaaatgggagtcaaagttaccaattttaggcaaataccttcacaatgaaagttgactttagcactctttttctccttgattt

SEQ ID NO: 1703 - DNA, 661 bp, Homo sapiens
  misc_feature [331]..[331]: Chromosome 18, SNP identification no. = rs677592
  misc_feature [331]..[331]: allele = t, in linkage disequilibrium with rs10503122, respectively
  misc_feature [331]..[331]: n is a, t, c or g
tgtgcctcaaattaagcagattaaagagtaactcgaagagagtcttgcctggaagtaaataaacaaataaacagaaataactaagaacagtttcctaaatatgtcagatacagtgattgcaattgtttttcaagggagagaagagattcaaggttgacaagtatattgcaatgaatcaaatgggaaattttcttcgatttttaaaggaagattcccattacttgctgttaggttacaggtactagattcaaaattagtttagaaactatagagcttgcataagggtattcattaaaccactgatccataagtttaacaagtgaggtaacantttcaggcaaggaaatgggagacataacccaagaccagcacctacaatctaacagcagaacaactttatgaccgtcagatgtgcttgggactctagaagagagtcaacgttttccctctccatattccaaactgtcgtagtatatttcttttaattaatggctaaagttactggttactgagttcaaaatctctctttgccagaaaaggaactttcttaattttccaaaaacaacaccatccatctttttctaagatttgccatttctttttcatcaactaatttgctctttaggaattcatatttgatttctaccatttctgtataagt

SEQ ID NO: 1704 - DNA, 661 bp, Homo sapiens
  misc_feature [331]..[331]: Chromosome 18, SNP identification no. = rs11151465
  misc_feature [331]..[331]: allele = c, in linkage disequilibrium with rs10503122, respectively
  misc_feature [331]..[331]: n is a, t, c or g
agagaagagattcaaggttgacaagtatattgcaatgaatcaaatgggaaattttcttcgatttttaaaggaagattcccattacttgctgttaggttacaggtactagattcaaaattagtttagaaactatagagcttgcataagggtattcattaaaccactgatccataagtttaacaagtgaggtaacattttcaggcaaggaaatgggagacataacccaagaccagcacctacaatctaacagcagaacaactttatgaccgtcagatgtgcttgggactctagaagagagtcaacgttttccctctccatattccaaactgtngtagtatatttcttttaattaatggctaaagttactggttactgagttcaaaatctctctttgccagaaaaggaactttcttaattttccaaaaacaacaccatccatctttttctaagatttgccatttctttttcatcaactaatttgctctttaggaattcatatttgatttctaccatttctgtataagtttgattgccagaaatcctttcttttagctctgacactattacatttataattgagtagctgcaacactgttttatgtgagatgtacccggttttagtttgccgtctcagcagatattgctgattcagagataaaca

SEQ ID NO: 1705 - DNA, 661 bp, Homo sapiens
  misc_feature [331]..[331]: Chromosome 18, SNP identification no. = rs499881
  misc_feature [331]..[331]: allele = g, in linkage disequilibrium with rs10503122, respectively
  misc_feature [331]..[331]: n is a, t, c or g
caaaatctctctttgccagaaaaggaactttcttaattttccaaaaacaacaccatccatctttttctaagatttgccatttctttttcatcaactaatttgctctttaggaattcatatttgatttctaccatttctgtataagtttgattgccagaaatcctttcttttagctctgacactattacatttataattgagtagctgcaacactgttttatgtgagatgtacccggttttagtttgccgtctcagcagatattgctgattcagagataaacaggattttggatgtcatcaggtcaaatcttttttttaaaaataagtagtnaacaaacaaagactaagtcacagtgaattgagaaactttccctaaagtcactcagttaactgaaatatgtttatgttaaaaaattcccaaatcccgcatgcataactgattgaataaatcatatgcttattcaaagagcatttattgaaaaccaaatgcttatcaagctaatgtgctgggaactggggataaaaaggtgaacagggcatgggaactgctttgaaggaattcagacttggggaagcagaaccatgaagaaatagtgatgacttctggtcaaagtgatttctagttataatctacaatgatgaaaaggaagaaaaccagaaa

SEQ ID NO: 1706 - DNA, 661 bp, Homo sapiens
  misc_feature [331]..[331]: Chromosome 18, SNP identification no. = rs1676853
  misc_feature [331]..[331]: allele = a, in linkage disequilibrium with rs10503122, respectively
  misc_feature [331]..[331]: n is a, t, c or g
tttttttataataacatgtattgctgagcctttgtagattattttagttaaagtgagaaaatgttttaatttcaatttttaagatctaagagatataactagaataacagtcattgaggtatttttgagggtttctagaattagacaaataatgtaaatactgaagctacttttattatagctatattgtgtaaataatttctatcatttaaccagaaagtgaaattttctgatttcagtgaataggaatgcaatttctctttgaagaagcaatagcagtcttgttcttttactgccctatcaaatacattatcatcattgaattttcttngaaagatggttaataatgtttataggtccaaattttcatttttgtacttctaggatttggattaaattatgtatttttattccgcttatcacccaaaagtttatatttttacttatttggtgcattttagagttcatgaggaaaatcaacctatacacctctttgtccttgttgtgtaggaatataatgaaataaaatcacctttcaaatatatatatatatatacacatacacacacacatataaaaatgtaatgatttattccttttcctcttctctctcaaaggtttttgaagtcaatacaagctatgtctgtgtataggaaagtat

SEQ ID NO: 1707 - DNA, 661 bp, Homo sapiens
  misc_feature [331]..[331]: Chromosome 18, SNP identification no. = rs10503122
  misc_feature [331]..[331]: allele = a, g
  misc_feature [331]..[331]: n is a, t, c or g
tttattatagctatattgtgtaaataatttctatcatttaaccagaaagtgaaattttctgatttcagtgaataggaatgcaatttctctttgaagaagcaatagcagtcttgttcttttactgccctatcaaatacattatcatcattgaattttcttagaaagatggttaataatgtttataggtccaaattttcatttttgtacttctaggatttggattaaattatgtatttttattccgcttatcacccaaaagtttatatttttacttatttggtgcattttagagttcatgaggaaaatcaacctatacacctctttgtccttnttgtgtaggaatataatgaaataaaatcacctttcaaatatatatatatatatacacatacacacacacatataaaaatgtaatgatttattccttttcctcttctctctcaaaggtttttgaagtcaatacaagctatgtctgtgtataggaaagtatgccatggaaatattagtgctttatttaattagctaattgcactgcatatttctttttcatctgaatggatatttttgcatgtcctctgctttgacatcagagttatgatatcctcagcttttttcgatctggatcaggggtgcattaccctcctacagttcagagacactg

SEQ ID NO: 1708 - DNA, 661 bp, Homo sapiens
  misc_feature [331]..[331]: Chromosome 18, SNP identification no. = rs656681
  misc_feature [331]..[331]: allele = t, in linkage disequilibrium with rs10503122, respectively
  misc_feature [331]..[331]: n is a, t, c or g
gagtggagagcctctttcctttattttttagtgcttgttgcagtcttgaagtttcctaaaactttgtgatgtgtctctccctgtcccttgtgctcatgctaggaagcctcctcagagagtgatctacttcattcaaatgtcacttcttccagcattagactctgccgtccaagcagctgctgtgtgtgtgagcagagagaaaaggtcccaagccctgtggtcaggcaggcaatgcattgataatcctgatggtttatacctcattggtttgggtttacactgcacttagatattctaccagatactttgggaagactgacttttaccttgntgacagccttctctttcagatattgggtgatgtagtttcccatgtttagatgtccctgtcatcagttcccatatatttttggtgtttagaaagtcccaaaaatgtcttgtctgatttacatcagaagatgtaaatcaccctttcttgatttcaccattgttagaggcttatttttagagcaagagcaatacttttatgttatgggaaataggagaggaaacatactatacggagcctattatattaaattaaagtctgctgataacatttatgagtgtttttgagtataattgactcaggtttaacagttgatactcaagactaaactcc

SEQ ID NO: 1709 - DNA, 661 bp, Homo sapiens
  misc_feature [331]..[331]: Chromosome 18, SNP identification no. = rs17079705
  misc_feature [331]..[331]: allele = g, in linkage disequilibrium with rs10503122, respectively
  misc_feature [331]..[331]: n is a, t, c or g
caaacctcacctccaacactggggattacaattcgacatgaaattggagtggggacacagattcaaaccataccagccatcaaacctggttaatgtcatgactaattaaatgtaatactttagaaattcataccttataataaatgcaatattgtttttattaaagaatatgttttaccactcaatcattatttatatagatccttgtaatattagaaaagtaataattttctacatatatacatttttaattcccaaaatctccttcagtaaaacatgtggtctaacataagcaacatgttaggatcaagaacaaacctagatcttttantacttggttcagattgtctttaaagccatagattatgctatcagcattactgttttggtaactttttttttttattaaagttttagtgtacttgtgcacattgtgcaggatagttacgtatgtatacatgtgccatgctggtgcgctgcacccaccaactcgtcatttagcattaggtatatctcccaatgctatccctcccccctccccccaccccacaacagtccccagagtgtgatattccccttcctgtgtccatgtgatttcattgttcaattcccacctatgagtgagaatatgcggtgtttggttttttgttcttgcgatagt

SEQ ID NO: 1710 - DNA, 661 bp, Homo sapiens
  misc_feature [331]..[331]: Chromosome 18, SNP identification no. = rs8092610
  misc_feature [331]..[331]: allele = c, in linkage disequilibrium with rs10503122, respectively
  misc_feature [331]..[331]: n is a, t, c or g
attagaaatacaaaagttttctaaacccattagatttccacttatgtttcattggcaaaactgcaccacacagccaaatatatttgtatgggaggcttggtaacataggcttcaaaaaaaatgaccacattgttgctccaaacaaaaataaaaaattgttttgtagggaggaaagggagaaaggatactgggtaggtaaatatcagaacccacagggtggatgtaatatgtagaatgaaactggaatccactaaaaaaaaatagccttcattgatgtgtgctgagtacctcaagacattataaacttgccaacaaattttggaaacctcanggctgaatttttctcgtctctttatcatatgcccccaagtgattgttatatgatatggagtgttaggataatggaggtgtgtgtgcacaggggtattataaccatggtgtcgatgtaccctttgaaactaggatggagaccatagataactttgttttttattctgagaggtcccatgctatcaatgaacaaataatttgtgaggcagacttggcaataaggatgaagtaggacaccttctccattttctgaccctaatggttgtggcctgtgtggggcaaaaagagccttcacatgagaaagctgcaagtaagacagtgccctccatat

SEQ ID NO: 1711 - DNA, 661 bp, Homo sapiens
  misc_feature [331]..[331]: Chromosome 18, SNP identification no. = rs17079717
  misc_feature [331]..[331]: allele = g, in linkage disequilibrium with rs10503122, respectively
  misc_feature [331]..[331]: n is a, t, c or g
ccataatcatcatcatcatcattttgccaacacataatagcattttctgcttgcaaggtgatttacatacatatccacaattttgatagctttgcaagaaaatgaacattattttacacattattttcattttgcacttgaaggaacctgctgttcagaaacgttcaatgatttgcttaaagccacagataaagaaagtgagggaaccagaatttcaaataatgtctttctggctccagagctatttccacgatgttgtgctggtattctaggaatgtgaatctggcagaagtcgagcagaatggtttgaagtggacactgggattttagngtgcagggaggaggtcgtgagacaacagcccaaagatccattccgatattctataaatccagacgaattactgttctatcagttgggccacacttttcctttgggaattgagagaagagactgacgctgcaaataaggggtaatttttacatttaaattagcggccctcagattcaacacttatgcttttctctctcttacattttcttaaatctacttagagaaggtatcttttgcattctcaaagaaaatgtcatcactgatttgcactgaatattacctattcacaaatgagatgtgtgaggtggccaggaataacactggggatgt

SEQ ID NO: 1712 - DNA, 661 bp, Homo sapiens
  LILRB2
  misc_feature [331]..[331]: Chromosome 19, SNP identification no. = rs383369
  misc_feature [331]..[331]: allele = c, in linkage disequilibrium with rs798893, respectively
  misc_feature [331]..[331]: n is a, t, c or g
tgctgattttttctccctatatagacggtactcctgggcttcaaggctcccctgacaactgagggtgacgggactcccctgggtgatcacagagtctggctcagcccacagggtgggcttgggaatggtccctggaaggaaatcaaaggtcagattcgaagtcatttcccacccaacagatctcagctctcagcccaggaccctccagatgcccccatcagtcagtccagaacttctaatccccatccccagctgcacggaggtggccccttgtccccagtgaggaggagggacctgggagagctggggacagactcacctgtctgcacgngggtcctggggcccagactcagccctggaagagagttccctgtgagggatttgccccctgaagcctgagcaggtcctcccctccctgggatctttgtgagcccctggggtctccttagggaccagagtttggctgtggggtgaggtccctcctaggttagaagctcccctctctcttcaaatctcaccgagacagatcaggactgtgacgatgggggtcatggcgtctcctcccactgccctgctctgcggatggatgagccctcggtgctggcgggacagagacacacagagagaaatagcctcccctccttcccaccctgtgtggaca

SEQ ID NO: 1713 - DNA, 661 bp, Homo sapiens
  misc_feature [331]..[331]: Chromosome 19, SNP identification no. = rs431420
  misc_feature [331]..[331]: allele = t, in linkage disequilibrium with rs798893, respectively
  misc_feature [331]..[331]: n is a, t, c or g
gttcaatatatgcaagtcaataaaagtgactcatgacataaactaagaacaaaaagcatatgatcatctctatagatgcagataaagctttcaagaaagtccaacatcgcttcgtgataaaatccctcaacaggctaggcatgaaagaaacataccgcaaaataccaacaccccctgcgtgacaaacccacagccaacatcaaattgaatggggagaagtgaaaacattttcccaggaaaatgagaatgggatcctccctagcccctggggtctcctactggaccagggcctatctgtggggcagggtccctctcatgctagaatctcccnttcccctcgtcaaatctcagtgaagtggaccatggccatgggagtgacagtcatggcacagagaggcagggctctcctgtagcaggacgagccgcagacaaaactcctcagacaccggattaaagaaggaagaggtttttattcagctgggagcgtgggcagactcgcgtcttaagagccgaactccccgaaaaagaaattcttggcctttttaaaggcttataactttaaggggtccacgtgaaagggtcgtgatacatcaagcaagcgtgggaaacatgactgtggggggctatatgcatcagctaacagaacaaaaagttttacagt

SEQ ID NO: 1714 - DNA, 661 bp, Homo sapiens
  misc_feature [331]..[331]: Chromosome 19, SNP identification no. = rs386000
  misc_feature [331]..[331]: allele = c, in linkage disequilibrium with rs798893, respectively
  misc_feature [331]..[331]: n is a, t, c or g
caaggggtgttcccacacaaatacccactcgacttcctctctcactttggggtactcctcagagactctccttccttcttgggaggcaacggaagtggaccttccctggttgagtccttccgtggtgcaggtaaacgtcgatgcagggccgggagttactctgctcctgtacagtccgtctgtcactttcctctagtcctctctacggtacgcacagactttatagtcgtctttcggaccacggacagagtttcctaccaagttatatacgttcagttatttccactgagtgctgtatttgattcttgtttttcgtacactagtagagttngctacgtctatttcgtaagctctttccggttcaggacccttttgtactcggtcgccccaggccctgtcgagtggtgggtacctctacgaccacccttttaggacattcaccctcattccttcctctggtgatgatgaggacgacgggaggaggggggtggaacggatcaagtgttttgtccttctctctttttcggttttcaacctttttatgttttcattctatttatcggtctgttggaaccgtggtggtgggccggcatcctcaatttttttcattattattattgtagttggggactggatttgatgaccacaatagacatttaag

SEQ ID NO: 1715 - DNA, 661 bp, Homo sapiens
  misc_feature [331]..[331]: Chromosome 19, SNP identification no. = rs398217
  misc_feature [331]..[331]: allele = g, in linkage disequilibrium with rs798893, respectively
  misc_feature [331]..[331]: n is a, t, c or g
ctggctcatgttttcccaggacttggcctttctcgaatgctttatctgcatcggttgagatgatcacatgctttttgttcttagtttatgtcgtgagtcacctttattgacttgcatatattgaaccatcctttgagacaggcaccaggctttctgctgatatttcagacacgcatggcatctctcctgatctcctttcactgtctgcctgacatgtcctcgtctcattgagggccgggacgtagctgcaaatggacgtggtgccttcctgagttggtcccttccaggtgaaggcaacggagggttcttccttcctctcagagactcctcntggggtttcactctctccttcagctcacccataaacacacccttgtggggaacctaccatggccagtcttctcaccagtcctggggaagcttcagggaagatgcaaattcaggctgcggggcagactcacatcagcagagactcatctcacatcttgctgtgcagttccagttgagctttattgtggcgatgaacagaaaggggaaatacagggagacaagggaaggaatcatgtctcttttcccagaactggagtgtgggttttctttatgcaaaaacgttcccttcacgaacttctcattcactcatcgcaacagcgtccgcccccgg

SEQ ID NO: 1716 - DNA, 661 bp, Homo sapiens
  misc_feature [331]..[331]: Chromosome 19, SNP identification no. = rs798887
  misc_feature [331]..[331]: allele = g, in linkage disequilibrium with rs798893, respectively
  misc_feature [331]..[331]: n is a, t, c or g
tttctgctgatatttcagacacgcatggcatctctcctgatctcctttcactgtctgcctgacatgtcctcgtctcattgagggccgggacgtagctgcaaatggacgtggtgccttcctgagttggtcccttccaggtgaaggcaacggagggttcttccttcctctcagagactcctcatggggtttcactctctccttcagctcacccataaacacacccttgtggggaacctaccatggccagtcttctcaccagtcctggggaagcttcagggaagatgcaaattcaggctgcggggcagactcacatcagcagagactcatctcncatcttgctgtgcagttccagttgagctttattgtggcgatgaacagaaaggggaaatacagggagacaagggaaggaatcatgtctcttttcccagaactggagtgtgggttttctttatgcaaaaacgttcccttcacgaacttctcattcactcatcgcaacagcgtccgcccccggtctccctggaaacaacattgacctgactctgccttcttggtgcccccgtcttctttcaaacactcctgttcccatcctgtgctcctgagttcaaggttctgggacaatacgtggggttagcactctgctttgagggaaaatcttgtcttt

SEQ ID NO: 1717 - DNA, 661 bp, Homo sapiens
  misc_feature [331]..[331]: Chromosome 19, SNP identification no. = rs798893
  misc_feature [331]..[331]: allele = c, g
  misc_feature [331]..[331]: n is a, t, c or g
gagggaaaatcttgtctttatttaaatattcatgtgtcaccccctgcctgtgtgaccttgggcagtaacctcccatttctgagcctcggtttcctcatttggagcctgtgatgaaccccatttatcacaggggagctgggtcattggagcctggggactgcagggggctcagccatgggtaatttccagagcaggtgaagacaggaggggtgggggcatgaggggatgctggcgcccaccatcaaggcctgagattgatgtttccactaaggagagcccctttgttcctgcccttgagagatgcttctcataatatttcatcaacaccccngttatcacagtcatgtccagaaaatgagaaatgaaagcttgtcagaaggagaagcgcctgcattaaagagaaaattaaaactgacagagcatttgtgtctggtgccattggggtcttcagggaggaagtaattaagtcactagtgtgcatacatttaagcatgaaatgcaaatcttttttttttttttttcgagacagagtctcactctgtcgcccaggctggagtgcagtggcacaatctcagctcaccgcaacctccacctcccgggttcaaacgattctcctgtctcagcctcccgagtagctggcactacaagcacgcaccaccac

SEQ ID NO: 1718 - DNA, 661 bp, Homo sapiens
  misc_feature [331]..[331]: Chromosome 19, SNP identification no. = rs416867
  misc_feature [331]..[331]: allele = a, in linkage disequilibrium with rs798893, respectively
  misc_feature [331]..[331]: n is a, t, c or g
cgaaatctggctcaaatgtttggcctggcacaaccaaactagaacttggaagacgctgtataggtaaaacataatattgtaatcattcatattctgttaaggctttgaaaatgtccttaataagatttctttatcctggaaggtagatggcaaatgataacatttctttattctagagggtagatggcaaacgataagatttctttattctagaggttagatggtgaatgatatgatttctttattctagagggtagatggtgaatgataacatttctctattctagagggtagatggtgaatgataagatgtctttattctagagggtanctggcgaacgataagatttctttactctagagggtagacggcaaatgataagatttgtttactctagagggtagatggtgaatgataacatttctttattctagagagtagattgtgaatatttggtccttcatgttttctcaggatcctccctccaaacattctatcctatacagcaaagctttacatccttcaaacacaacagtcgtcttggacctagatatgttgaactctttaatgctaggactcaagtcctcttgctgtttgggacaattcagaaaagaatcagccccagtcattttgcatacttctgtctgactgtcataggtg

SEQ ID NO: 1719 - DNA, 661 bp, Homo sapiens
  misc_feature [331]..[331]: Chromosome 19, SNP identification no. = rs384116
  misc_feature [331]..[331]: allele = g, in linkage disequilibrium with rs798893, respectively
  misc_feature [331]..[331]: n is a, t, c or g
tattctgttaaggctttgaaaatgtccttaataagatttctttatcctggaaggtagatggcaaatgataacatttctttattctagagggtagatggcaaacgataagatttctttattctagaggttagatggtgaatgatatgatttctttattctagagggtagatggtgaatgataacatttctctattctagagggtagatggtgaatgataagatgtctttattctagagggtagctggcgaacgataagatttctttactctagagggtagacggcaaatgataagatttgtttactctagagggtagatggtgaatgataanatttctttattctagagagtagattgtgaatatttggtccttcatgttttctcaggatcctccctccaaacattctatcctatacagcaaagctttacatccttcaaacacaacagtcgtcttggacctagatatgttgaactctttaatgctaggactcaagtcctcttgctgtttgggacaattcagaaaagaatcagccccagtcattttgcatacttctgtctgactgtcataggtgagtagaaagaaacagctcaactgcttgacaagattcatcgacctgaggtcttgtctgcagctggatttctatcctacttccgtgatttt

SEQ ID NO: 1720 - DNA, 661 bp, Homo sapiens
  misc_feature [331]..[331]: Chromosome 19, SNP identification no. = rs103294
  misc_feature [331]..[331]: allele = t, in linkage disequilibrium with rs798893, respectively
  misc_feature [331]..[331]: n is a, t, c or g
gagtatggcaatgaggaataaagaagactgtgttacacaccatggaccagagcacacagatgtgcagaggtgtggatccagccctgccatgtgggatgtagcctcatgtctaggggtgggaaaagaaggggatccaaccaagggaagtcaacattaatagagaggaaaggtatcacatgttaatggtcctccatggatcaccctgcaaaatatctctgcaatccaacactgattcctccttctagaaattatcagcagacagtccagatagcattggccctaaattgtctcccggaacctcctgggatcaccatatctattcccaaggttncaccactctgagagatgcattgtcctctctgctgttcacctcctagctgcatcttaggggcttctctggctgtgctgagcctcaaataacagaatcctgaggaccaccaggatcaagccagccttgcccatgtggatgagattctccactgtgtaatcctgggggtgtgaggttggggatggtgggcaaagagaccacagaggtcagggcagatcaacatcacccaggacctctggatgtccacccagggcacccacctccccttcacaggacctgaccctctgtgccagccccataactgaaagcatctcctcacgcaccagtcttggg

SEQ ID NO: 1721 - DNA, 661 bp, Homo sapiens
  LILRA3
  misc_feature [331]..[331]: Chromosome 19, SNP identification no. = rs410852
  misc_feature [331]..[331]: allele = c, in linkage disequilibrium with rs798893, respectively
  misc_feature [331]..[331]: n is a, t, c or g
catcgaccctgatgtccgcgggtggtggtgcgggccgattaaaaaatataaaaatcatctctgtcccaaagtgacacaattggtactaccagagctagaggactggaacactacacgggcggagtcggagggtttcacgactctaatatccgcactcggtggcgcgggccgacacaaacctacaaaatttcgtgtcaccggactccctttgactgacccgccgagggacaccgtaccctttgggccccctccagtcgcccccgatgtcacgtcgggtcgagacccggaccccccaagtacaggttacaacaggttagtgacctattaagantgtagattgatttggagaaaatatcctttttctctacgaaattttaacaattaaatttaaatttagtcttctcccgttaaaccattattcaattatactttatgttacttatatgggtttggtcatcgaaagagtacccatgaatagaaaacaaattttttatatttccttagtttatgaagtgaatattcaacagtttccacaacttattaaacagtatactcaatggagacttatacagagaagaggagacaaaactaagagtcctcgtcgactctgggagtcgggtggtgttttgttcaggctgaggttccgaccactcactcctct

SEQ ID NO: 1722 - DNA, 661 bp, Homo sapiens
  misc_feature [331]..[331]: Chromosome 21, SNP identification no. = rs2825896
  misc_feature [331]..[331]: allele = t, in linkage disequilibrium with rs377685, respectively
  misc_feature [331]..[331]: n is a, t, c or g
ttactctcaatgctagtttaacagactttctcaacccaattctctcaattcactggtgactgtttttaggctctccagaaaaagagaaggtaggatcattccctgaatcttgtctttctcttgagttgctgtatttagttgagaagtttcactggtcatttgtcactcaaagtatttattaaatcctatttcttattctttgggatcaaaaagaaggccgtgttttcactcatataagaacaaagaaataaatatcccaatctcactcttctcctaacttctgatctcttgctgctgctctccaatggccaaacacatcagggagcaaatnagacttttggtgcaggtcagtgtcccagggcacaaagcagagacgaatggagagtgcatttggagagacaaaaagcggatagcacagcacttacttcttacgatttttcttcatgtggatatggaaactcttttggttccagtttatattcttaagccctccatcgttaaaggaacacagaaatctttagtaacaattctaagacatattactacatatttaaaacctagacatatgcaattgaatttttctttaaatcattcataaattcactatcaatctcataattgtgaaatcacaagatatatctacttgaaattctgaaggtga

SEQ ID NO: 1723 - DNA, 661 bp, Homo sapiens
  misc_feature [331]..[331]: Chromosome 21, SNP identification no. = rs2825899
  misc_feature [331]..[331]: allele = a, in linkage disequilibrium with rs377685, respectively
  misc_feature [331]..[331]: n is a, t, c or g
aagaataaagtaattcaatgctataaaaacatgaaaaggaaaagatgaaaacaacataatatttgctctcatggagctaatagaaattggagaccaaagtaaaacaaacagttaaaattctatagaaaacattataatgggtttacctatatgtgctatttgaggcacaaaaagttagacattatctctatcctggagaaaccaaagaaacatttgtgacatatcatttgacccaagtccttaagaattactgcagaatttttaattctgtatatccttcaaattcaagttcatatttcttcattacagcattttagatgcaggaacacanaggtaatttctcttgaatgtccctaaaaccatatttatgctttggagctaaacttctgttctagtttattctgagtgtgtatacatatattatctacattaataattcaatttgtgagaatttgattgcagtttgattatatttatatctccccaagtacctacctagtgcactaaatgactgtaacctacttaggacaggaaatcccaagagtcattttgattatgtaatgcttaaattcaatagttgcaatatatgaagactctatttagtaccttgaatctcagtagcaactaccagttaccagaaagtttctataacctaaagtta

SEQ ID NO: 1724 - DNA, 661 bp, Homo sapiens
  misc_feature [331]..[331]: Chromosome 21, SNP identification no. = rs2825905
  misc_feature [331]..[331]: allele = a, in linkage disequilibrium with rs377685, respectively
  misc_feature [331]..[331]: n is a, t, c or g
tttttccttcacctgaattcaccatgaatcagaaacaaagatgtaaagatatacatgaaactaaatttactttgaggggggaaatccggtgaaactaatattgggtaagaatagagtaagattggagagacaattcataacaaatgggaagagaaatgtaatatacggatttgaaggtcaagggtgagaagccaccaacagcaaggaccagggaactggtacaaaaagtctattggacaagctattctcaggtgttgattgagctgcaccaagtcagtatttgtagcaatatactggtatcctgaaaggaaatgcagttcttgaataacantattttaaaataaatggtaaaaacaagaaattctgtcaatagcaaattattaaataggttatactccatccacattatgtggcataattcagcggtacaatgtttaggtgtagctactgtataatatgaatatatatgtaagtatgcatatacacatatatatgtaaatgtgtacacatgcatataggtatgcatatatatatgtgtgtgtgtgtgtatatatatatatatgcatatgtaagcctagagaaaaaaaagattggtgtccccaagccattacatattttattttgtgtatttatagaagggtgagggtggggttgagtagga

SEQ ID NO: 1725 - DNA, 661 bp, Homo sapiens
  misc_feature [331]..[331]: Chromosome 21, SNP identification no. = rs2825910
  misc_feature [331]..[331]: allele = a, in linkage disequilibrium with rs377685, respectively
  misc_feature [331]..[331]: n is a, t, c or g
agaaaactctgctccccaaagagaaattgtccttttaataatatattcttagattagaagctcaacatgctgtaattttctcgtgaaacatcctgagttggctgttcataggtgcctacttgtggtgattggcgtccattaatcctggtgaggatatgaaaaccacacagctactagtttgacaaccactgcagcagtgcctcatgaacatagtgttttcatcgttcttccaaacactgtcaattaggcctttgaggtatagatttgcagtataagtaaaggacagtttggtagccatgtagcaaggatgagctaaaaagaccataccaanttgagctcagtaagttccagtacatacacaaaactgagcccacatcaaaacagaatttttacaccaggagcaactttgaatcttcattgggcttgcatgaaaatgtcagtgtggcttatggtgaagaatgggctcaaattatataaagctgagtagggtaaagactgaatgaaagatagattatattctacttgagtagagtcagtaatggataacaaggcataaggacataatttcacatttgaatggtgttttattttgaagatatgtaagaatgcacacatatactactatacacatacatacatatgcattcaccaggactatgtc

SEQ ID NO: 1726 - DNA, 661 bp, Homo sapiens
  misc_feature [331]..[331]: Chromosome 21, SNP identification no. = rs12482291
  misc_feature [331]..[331]: allele = c, in linkage disequilibrium with rs377685, respectively
  misc_feature [331]..[331]: n is a, t, c or g
caatatttcttgctctgactacactgacttcatcatagtatcttagactttcatagttttaatatcaactgggcaaattcaagctagagttcttcaactgggtttcaggcttgggatgaatcctttgtggttctcagttacgttctctgaactcttggttctgactactaggcttttagttctaacccctgatttctagcttctaccctctgagtcatccgtcatatttcatggaaattaccacctgcttcgaactaactagtttatcagcctacgctggccagtataattttgggggtccaacaggattcttccattctgtgctctctcngtccttttcagtcccaaacggaaggatttctgatgggaaaaattcaagaaaatcatgggccatgcatgaattgcactgggtttcaccctcttagacaaaatccatttccagacatattcctgctgtaatattttttctattgttggctttagtcaagatggctgtgggaagctcttaagcttcctctgatttgattaagaagaactttgaagcacacccttcctctattgtgcataaacatactgacatgttgatctgtccaaaaattcaggaaaaaacttgtacagaaatatgctcccttttttctataccacactttaagctgggata

SEQ ID NO: 1727 - DNA, 661 bp, Homo sapiens
  misc_feature [331]..[331]: Chromosome 21, SNP identification no. = rs2825922
  misc_feature [331]..[331]: allele = a, in linkage disequilibrium with rs377685, respectively
  misc_feature [331]..[331]: n is a, t, c or g
gtttattgtgtttgaaagataaagcagctttatatttaattaaattggttttttgaatcacacttaagcaaatacttaacacttgcacaaaatcatgtctgactttctaaattctttctaatactttttgttttgtaaatttttctacacatgaattatattacaaattatgttgtaattcaaatttgttatactttggtggtcattttttctaaacaacttcagaattgtatttttagagatttacatatttcaatgttgtcatgcacatttcaaagaaaattatatggaccagttttgtttcatgtaactgtactattttaatatgatngatgacttcttctttagtacttgagtaaatgtctcttattacctgaaatttctctgctttattcattcattttttccaactttatggtgataacttgtttaaaaagcacactttgtttctaacttggtaaatacaatgttttcttcattgtcttatgaaaaatagtgtttatgtacaatcaaatattatactttttcactgaaaaattatggctgcttcatatttatgctgtaatgatatttacagcattatccaaggttatggttttatagtgtgtggattttgagtgcctccgtaatatctcaaaaacgtctctttgcagcgtttatt

SEQ ID NO: 1728 - DNA, 661 bp, Homo sapiens
  misc_feature [331]..[331]: Chromosome 21, SNP identification no. = rs13047152
  misc_feature [331]..[331]: allele = a, in linkage disequilibrium with rs377685, respectively
  misc_feature [331]..[331]: n is a, t, c or g
atatttcttaaattattttaatttttactatttctaatatttttgtattttaatctttatattagagatataaatgattcatacacaatcattgcagtattagagtattctttatttgactctgcacctatttttatcagtgaattttatactttcaaaatatttgtgtgtgtgtgtgtgtgtatgtgtgactcattagcatccttttctttcagcttgaagaacttcctttaccattgtttataagacagatttggagttaaaaaacaaataaaactccctcagcttttgtttgtctggaaaaatgtttatatctccttcacatctgaangatggatttgctgactacagtattcttggctggcagtttggttgcttttttcctttagcactttgaatatatcaacccaccaacctcctggctggtaaggtttctgctaagaaatccactgatagttatattggcactcttttgtatatgatgtgtttcttacctcttggctgctttcagaattttttctttgtctcttttttttttgataatttgattattttatgttttgttgtatttctctcagggtttaattttcttggagacctctatgcatcccatatatgtgtgttggtatctatcacaggttaatgcagttttcagccatta

SEQ ID NO: 1729 - DNA, 661 bp, Homo sapiens
  misc_feature [331]..[331]: Chromosome 21, SNP identification no. = rs12482827
  misc_feature [331]..[331]: allele = c, in linkage disequilibrium with rs377685, respectively
  misc_feature [331]..[331]: n is a, t, c or g
agatggaattttactgtatagattattttgcatctggcattttttatttagtgagatatccagtcaatattaattttcatcattgttatgaaatattttattatatgaaaatacaaaaatagtgtgggtgtgtgtttgtgatctactacaaatgtgtagttttcagggttttttggctattgtctaacaacattggctattgtcttttttattttatttattctagtgtttgtgtactaaaatttaatcgtgattttatcttgaaggtctctgttgactaatgaggtagagcatgttttcctgtgttttagctgatccactttgtaggcancttttccagtgtttgcatttttgatctcttgaattgtctgactgttatgggttgaattgtgttcctcaaaaattcatgtgttgagttcctagcacccagaacctcagaaagtgactttctttgaaagtaaggtcattgcagatgtagttaggtaaaatgaggtcatactgaagtagggtgggctctaatataatatacttgatgcttttattgaaagggaaaatttaatttctgatacacagacacatagcgagaataccatgtgaagattaaagaagacattgagatgccttagcagaagtcaacaaatgccaaacattgccagcccac

SEQ ID NO: 1730 - DNA, 661 bp, Homo sapiens
  misc_feature [331]..[331]: Chromosome 21, SNP identification no. = rs377685
  misc_feature [331]..[331]: allele = t, c
  misc_feature [331]..[331]: n is a, t, c or g
caacggtaactttggggcacattaatgaaaagtcactgaccacaatccctattaaacacaagacgttcctgtgaagagaccaaagaccagtttatcgaggaaatttttttaaaaagaacgggataacacttcaaaagttcttctaagtctgtagggggttccatcagatattaaggtctactggtcatcgagaaccttcttctgattaaaggttcttctgtaatctcttttatgtttgtagaaaaaaacggtctctgttaagtaaataagattatgtaaacaactaataatgacactgggtacatgagaacatccacaaatcgtatcaagntacttatttcttcggggacatgaagttatccatctctgtcttaactacgtacggacagtctagaggtaaacactccctacattaattgacggttaatgtctataatacgagattttaatcagtaaacacggttcccttacgaaagacaacaaagagacacggttgctaacttattccgttcccacaatttccactagagtaagtcctcccactataccaagaagaaactaccctgtaaaactacgttcttgaaatgttatcggaacagttcagagaatccagacatatcgtccgattcaacgaagtaggaaatgaaacaagaaaaatagg

SEQ ID NO: 1731 - DNA, 661 bp, Homo sapiens
  misc_feature [331]..[331]: Chromosome 21, SNP identification no. = rs7281221
  misc_feature [331]..[331]: allele = c, in linkage disequilibrium with rs377685, respectively
  misc_feature [331]..[331]: n is a, t, c or g
tcaaaatcttaaggagatgtgtgtgactttcaactccaggagctccgtgatagcttgcctcatattttcctgaagattaccattgcaaaatggtgattttccacctgacacaacttgttctcattcaaaaaatttctctgtaaagtattacaggtaacagaataactggagccaaaattcctcttagtaaggaaacttatgttagaggaaaatagctgcttagaatagaatgtttaatgtagaatctcgttaaatgtgggcttctctatgacagttaatggaaagagctggacacataagagatgcagcaaattctttgaaagaaaaaacnaattcagtaaagaaaatgtgatacttactttaagggatttctacagaactgtaaagacctaatcctacccaacccagaagaattaaatcttagggaagcaaaatgatgttcattggaaatggaatatagattcaaacttaactagagtttagtgacacaaaaccttgaagtgctttcaggattacataaatttctggttaaaatttaaatctttcatctgatggagtagctcattaacttccagggagaagggaaaattatatgaagtagcttacaagatagaggttcttggcccagcaaaggttgataacagtggagagtgtgctaaag

SEQ ID NO: 1732 - DNA, 661 bp, Homo sapiens
  misc_feature [331]..[331]: Chromosome 21, SNP identification no. = rs2825928
  misc_feature [331]..[331]: allele = t, in linkage disequilibrium with rs377685, respectively
  misc_feature [331]..[331]: n is a, t, c or g
aaatgtgatacttactttaagggatttctacagaactgtaaagacctaatcctacccaacccagaagaattaaatcttagggaagcaaaatgatgttcattggaaatggaatatagattcaaacttaactagagtttagtgacacaaaaccttgaagtgctttcaggattacataaatttctggttaaaatttaaatctttcatctgatggagtagctcattaacttccagggagaagggaaaattatatgaagtagcttacaagatagaggttcttggcccagcaaaggttgataacagtggagagtgtgctaaagttttgcagagttantgatttcctcagcagacaggtgaactgagttgggcctatgtgacccagagctctttgttctggcaactcaggctgtgagcaacctttgacacatcaatttttgtcacggattattatgttttctgtgtgagccatgatatgaaattgctgggaatcaataatttatgataatacattgaaagtatcctgagcaatggggaatccacgtggagtaaagcaccaggctgtggggaatcctcagaggtcatcatatttctttacaacgtccccaaagtgataactggcaatatttcacttacagttgataataacttttagaggtggatacta

SEQ ID NO: 1733 - DNA, 661 bp, Homo sapiens
  misc_feature [331]..[331]: Chromosome 21, SNP identification no. = rs2825930
  misc_feature [331]..[331]: allele = g, in linkage disequilibrium with rs377685, respectively
  misc_feature [331]..[331]: n is a, t, c or g
tttttttaggggaaatcacactggtagtggaggtaatttgtttttgcagaaagaagtgataatgttgtgggaggataaaaatagtggattgaaaatgattgtagagcatcaaaacacccaattttatgttatattttctgttgtgttgtaattaaaattttcattatctgtgacttcagtaaagcttctacagaacaaaaccttatcaccttatttactgtatggtgcaagatgaagtatgtgcttattaaccctctatgtagttttaaagaatgtgaggaaagtgactgagctccatatgcaaatagaagcaaggagcaagacatcagtnaaattggacagaaagaaaaaacacagattttgggatgatttaaacagcttagagctatcctccaaccatcactatgactaccaagtctttcagggattagcagggatgcggtgctataatctggaataaaacaatactaaacatcaaataatatttgagtcatgtaaatttcaaaggttgtattgttgatacagaaacacctgctagtggaaatattgtcaaaactttgtgtgtgtgtgtgtgtgtgcgcatgtggtgtgtgtctatgtgtgtgtgtaacaaaacaacattgaactttggcaaatagacttgcttaatccaaaaaatata

SEQ ID NO: 1734 - DNA, 661 bp, Homo sapiens
  misc_feature [331]..[331]: Chromosome 21, SNP identification no. = rs12482714
  misc_feature [331]..[331]: allele = c, in linkage disequilibrium with rs377685, respectively
  misc_feature [331]..[331]: n is a, t, c or g
aagtatagaagctgatgaagaatcagagagcatatgtaggtgtggatgtttaaaaaaatagcagtagagtctttgacactcctcctggttagtgttagggtatatgcttcctcccattgaatctgggcagacttttaactgctgtgactgtaatcgagtatggcagaagtgatactaaggcatgtctgatgttttcataggctgtgacagttgcacagactttctgtgattttgatgattttgacatttaagaagtactggtcaggcagctttagaatgtccctcacttgtgacctgtctcatatttttgtcatgatcagattagtgttanggaattttaggcagaaaaccatggaggtaaagtgccattctcatcatggatattgaggatgcacaaatatattattagaatgactcattactgttaatttttttttttttttttttttttttttgaggtggagtcttgctctgtcccccaggctggagtacagtggcgggatctcggctcactgcaagctccgcttcccgggtttatgccattctcctgcctcagcctcccaagtagctgggactacaggtgcccaccaccatgcccagctaattttttgtatttttagaagagatggggtttcaccgtgttagccaggatggtctcgat

SEQ ID NO: 1735 - DNA, 661 bp, Homo sapiens
  misc_feature [331]..[331]: Chromosome 21, SNP identification no. = rs2825941
  misc_feature [331]..[331]: allele = c, in linkage disequilibrium with rs377685, respectively
  misc_feature [331]..[331]: n is a, t, c or g
gagaattaaatttttcatatataaatatctacatcccactgaaaatgtgaagcaagcaaagatgataatataaaagtgcaaaatcaagtttaaggccatccattatccttttctattaacatatatcatgttactattggctcgtctacttttaaacagcaattctcttttatgtaaattaactaagagttcatttagaaatgatatttccccttataagtattcattttgtcagcttaagtaagagccaaatgatctcagatcagattcaatagggaaactgctgaagggaaaataagagaatcatgaaagagaatagaaaatcaatacntagcaattccccagaaattaaatgactctagggtggaggggtcccatgggacatagagagaggtagctggttctaaggatttgtcaggtctaaaccattagcatttccattaccaactcttcttttctgaaggggtattagaatgaattagaacctggtctgagtgcttagatagagcattatcatcaacaaaatcagtaatgttgttagcatcagggaagacacacatggagcattttccctctcctaagcagaaaaaaagatggaaatcttcctaaagactcaggtaatatgaagcatatgtacatgttttcgaggacatgagccctt

SEQ ID NO: 1736 - DNA, 661 bp, Homo sapiens
  LOC402037
  misc_feature [331]..[331]: Chromosome 22, SNP identification no. = rs727497
  misc_feature [331]..[331]: allele = t, in linkage disequilibrium with rs431319, respectively
  misc_feature [331]..[331]: n is a, t, c or g
tgcaaccacacttgggccagagctttattttaacgggatggatttccctggacttggtgttgtcagcatcagcaagaccgagaggaccctctagaggacaaatgtgcttgggtagaaggcttgcccatggggtcacagccccccatgtggagtaccttggccagggctctcctttgctctggcctggtagagtctgccccatgggctctaaccagggcatgtgtcccctgcttgactcacagtgttgggtctcccattttgtccccccagctttgtcctgaccaagagtgtgccttgactgctctgtgacctggtcagctgtatgttcccnctgcaggctcaaaccctagctggggccttgcttcttaccagacactgataaacatgttgtttgttgcctgaaacagtaaaagatctgacatgttgctaagcatgtggaaactggccccgccccagccaaattccttgcacccttatataaactccacactccaccccctcactgcagcatgcctaggcagaacctccatccttgccgtccctcgtgaggccatactgcagccttgtgtgtatggaagttcccctaacacatgctttggactgaccaccctcacattaagtgcttcttcctttggaattccaactggctctcatcccaact

SEQ ID NO: 1737 - DNA, 661 bp, Homo sapiens
  LOC402037
  misc_feature [331]..[331]: Chromosome 22, SNP identification no. = rs9613607
  misc_feature [331]..[331]: allele = g, in linkage disequilibrium with rs431319, respectively
  misc_feature [331]..[331]: n is a, t, c or g
gtggaggctcctgtgtctgagacgccatggatcttggctactccagaggccactccagctccctttccatgccaatactgaaaagaaaattctccccaaatccctgcagggataggatggccctccttgtgagagtttctggggagttcttcctcagagaatgagatctttgctgctcggtgggtggtgaaggttatggtggtgtcacgcttggaactctgtcagcttggcacactcaactcaagaaagacggagtcagggttgcccagaaccaaggaggggtgcagccagaagcatgtggtgggtgaagtttggccacctcagtctaccngtgactcgtggaaaaggcacaaagcagagaatggccacctcgcatttcctttggtacaaactgccattattttagtctccactgactggtcgggggaaggaccccatctcccatgagcagatgagccccaccaccctgcagcagctcccacaatgggccagcatcctcctctgaggccacagtccctctgcgggccaggccagacagagtcagagcgtctgtagccgcggtgtttaggtgtccccgtgctctcagggtgactaatgtccagctccccacagcacacggcagggcagtctgcagacctgggcctgactcagagctggcttc

SEQ ID NO: 1738 - DNA, 661 bp, Homo sapiens
  LOC402037
  misc_feature [331]..[331]: Chromosome 22, SNP identification no. = rs6417766
  misc_feature [331]..[331]: allele = c, in linkage disequilibrium with rs431319, respectively
  misc_feature [331]..[331]: n is a, t, c or g
cctgtgtgaaatctatggcctccatgccctccagctggatcactctgacaaccccctcttatgttctccaccccagattctgccattactggggcagctggagctccgtgtgtttggatgctgcaacacgcgggtctcagagagctctcggtatcccatctgcgggctctgcctctcactccgcagcacactcctggtgtggccccacctctgccccactcccctccaccttctccccaggtttccctctatccccacggggcatccccccagggcctctgtgccctcatatcctggccttctgccacccagcctgcaggacagagccctngaagagcaaagaccctgaggggcccagcatgccaggccgctccagtcctcgtgttttgggtatcctctcacttctctcggagcccccgttcacccacacggcacccctgatcctcctggcccctttatgcccgtgttcccagcaccacgacccccgcatacatcttttttttttttttttttttttgagatggagtctcactctgtctcccaggctggagtgcagtggcgtgatctcacctcactgcaacctctgcctcccaggttcaagtgattctcatgcctcagcctcccgagtggctgggattataggcatatgccacaacacctg

SEQ ID NO: 1739 - DNA, 661 bp, Homo sapiens
  LOC402037
  misc_feature [331]..[331]: Chromosome 22, SNP identification no. = rs6519750
  misc_feature [331]..[331]: allele = t, in linkage disequilibrium with rs431319, respectively
  misc_feature [331]..[331]: n is a, t, c or g
gccctccagctggatcactctgacaaccccctcttatgttctccaccccagattctgccattactggggcagctggagctccgtgtgtttggatgctgcaacacgcgggtctcagagagctctcggtatcccatctgcgggctctgcctctcactccgcagcacactcctggtgtggccccacctctgccccactcccctccaccttctccccaggtttccctctatccccacggggcatccccccagggcctctgtgccctcatatcctggccttctgccacccagcctgcaggacagagcccttgaagagcaaagaccctgaggggccnagcatgccaggccgctccagtcctcgtgttttgggtatcctctcacttctctcggagcccccgttcacccacacggcacccctgatcctcctggcccctttatgcccgtgttcccagcaccacgacccccgcatacatcttttttttttttttttttttttgagatggagtctcactctgtctcccaggctggagtgcagtggcgtgatctcacctcactgcaacctctgcctcccaggttcaagtgattctcatgcctcagcctcccgagtggctgggattataggcatatgccacaacacctggctaatttttttttttttttttttt

SEQ ID NO: 1740 - DNA, 661 bp, Homo sapiens
  LOC402037
  misc_feature [331]..[331]: Chromosome 22, SNP identification no. = rs9608684
  misc_feature [331]..[331]: allele = c, in linkage disequilibrium with rs431319, respectively
  misc_feature [331]..[331]: n is a, t, c or g
tttttttttttttttgtagaaatggggttttgccatgttggccaggctggtctctaattctggatctcaggccatccgctcgccttggtctcccaaattgctgggattacaggcatgagccactgcgtctggcccccgaatacatcttgactatgtcctgccacctccctcctcctgccctgggcccaccagcgcctggacagcactctgcctcgcccaccccctcccaccaccccagctcacaccttcggggctctgctgacccctcctgtcccgccctgtgtaacccttactgctctcctgctcagaagcctcctcctacctccatcantggcggtttttctcgccacctctcattggaacgagtgggaccatctcacttcactgccacaccctctgcactgacagacagccgggcccggcacccagaatccctgggtgaatggcaacatcccttagaatgacaaggactctgttcccagtttcttcctccccgtggaaacctgcccttcaattgctcatctcagcctgcagtccgtgcacccctaccccagcctgtccctcagcccctcctcaccctcccttgggcctgagctctggttggcagtgaggtgggcgctgtggggaggagcgtacaggaggtgcgaccagagccccttgg

SEQ ID NO: 1741 - DNA, 661 bp, Homo sapiens
  misc_feature [331]..[331]: Chromosome 22, SNP identification no. = rs9613641
  misc_feature [331]..[331]: allele = a, in linkage disequilibrium with rs431319, respectively
  misc_feature [331]..[331]: n is a, t, c or g
ggggtttcaccgtgttagccaggatggtcccgatctcctgaccttgtgatcggcccgccttggcctcccaaagtgctgggcccatatcagggttttaaaaaatgtgtttgtaatttgtactctcggcagggtattcttgggctgcaggggttgttgtcaatgtgtgatttgtgtttttattttatagaataatgtgatgtaccgatttttataagtgatagataattcgaataactgtatatttgacaacctattaaaatattttgcattggaacttctttcattaattgtaacatgctaacaaactgatagtggtttaaaaataactcantcattgaacaacaacaacaaaagaaaaaaggttaaaagtaaacatttttatgggaaatctcttatccaaaattctttcaagattttaccttatttagtgactagttctgtatttttgcatgaggaataaatatgtctctggaaggaaaaaaactattgctattaatagttatatgaaccttctagaacctaatctaataccagacaactgaggctaaagaaatgctagattgcagccccagtggccagacatgaatataagaaggaaaacaggctgggtgtagtggctcacgcctgtaatcccaacatatatatgtatatattgtggtgg

SEQ ID NO: 1742 - DNA, 661 bp, Homo sapiens
  misc_feature [331]..[331]: Chromosome 22, SNP identification no. = rs444763
  misc_feature [331]..[331]: allele = a, in linkage disequilibrium with rs431319, respectively
  misc_feature [331]..[331]: n is a, t, c or g
aatatggcgaaacccagtgtctactaaaagtacaaaaattagctgggtgtggtggcatgagtctgtattcacagctactcgggaggctgaggcaggagaattgcttgaaccaggaggtggaggatgcagtgagctgagattacaccactgaactccagcctgggcaacagaatgagactctgtctcaaaaaaataaaaaattaaaaaataaaaattaaaatcatttaaagttcatttctttagaatatttctctcaaattataaatgtaatattttaagcttcagtaagttaaagttacaatacaataaaaaagaattactgtagcagganaaaaataaaccatgagtgatgtagggggactattaaatggatattaattcataacagcatggatttttaaagttttttccttttttttttttttttttttgtgacaggctcttgctctgtcacccaggctggagtgcagtggcacgatcatggcttactgcagcctcaacctcctgggctcaagtgattctcccacctcaaccccttgagtaactgggaccacaggtgcgtgccaccatgtcaaaatcattttgtgtgtgtgtgtgttttttgtagagatggggttttgctatgttgcccaggctggtctcaaactcctgggctcagtga

SEQ ID NO: 1743 - DNA, 661 bp, Homo sapiens
  misc_feature [331]..[331]: Chromosome 22, SNP identification no. = rs415591
  misc_feature [331]..[331]: allele = c, in linkage disequilibrium with rs431319, respectively
  misc_feature [331]..[331]: n is a, t, c or g
gaggtcaggagtttgagaccagcctggccaacatggtgaaaccccatctctaccaaaaatacaaaaattagctgggtgtggtggcggccgcctgtaatcccagctactcaggaggctgaggcaggagaatcgcttgaacctgggaggtggaggttgcagtgagccaagatcgtgccattgcactccagcctgggcgacagagcaagactccgtctcaaaaaaaaaaaaagtaggaggagctcttcagtacccaagcctgcacagctctctgcaaaagcagcggggcatctatctgccttctctctgggtccagtcacaccacgacttggcnttgcagggaataaaatgtgcattaccataattattataaatgctatttactggttttcaattcttatgaccaacttagacaaaacaaagaaaacttcattatagtcacagaacataaacattatacattttgacaacacaaaactgatatactcctaattctcaaatgaaaataaattttaaggtggcagccacagatataaaggaaattaattaaaatacgattccatgttaataagctagaaagtattgataaaattgatggtatttctaagagactataatgacaaaatcagcaaaagaaaatctaaatagaatactaattttggaa

SEQ ID NO: 1744 - DNA, 661 bp, Homo sapiens
  misc_feature [331]..[331]: Chromosome 22, SNP identification no. = rs399401
  misc_feature [331]..[331]: allele = g, in linkage disequilibrium with rs431319, respectively
  misc_feature [331]..[331]: n is a, t, c or g
ccaacatggtgaaaccccatctctaccaaaaatacaaaaattagctgggtgtggtggcggccgcctgtaatcccagctactcaggaggctgaggcaggagaatcgcttgaacctgggaggtggaggttgcagtgagccaagatcgtgccattgcactccagcctgggcgacagagcaagactccgtctcaaaaaaaaaaaaagtaggaggagctcttcagtacccaagcctgcacagctctctgcaaaagcagcggggcatctatctgccttctctctgggtccagtcacaccacgacttggctttgcagggaataaaatgtgcattaccntaattattataaatgctatttactggttttcaattcttatgaccaacttagacaaaacaaagaaaacttcattatagtcacagaacataaacattatacattttgacaacacaaaactgatatactcctaattctcaaatgaaaataaattttaaggtggcagccacagatataaaggaaattaattaaaatacgattccatgttaataagctagaaagtattgataaaattgatggtatttctaagagactataatgacaaaatcagcaaaagaaaatctaaatagaatactaattttggaaaatatttggaaagaagtctaacaatat

SEQ ID NO: 1745 - DNA, 661 bp, Homo sapiens
  misc_feature [331]..[331]: Chromosome 22, SNP identification no. = rs933582
  misc_feature [331]..[331]: allele = c, in linkage disequilibrium with rs431319, respectively
  misc_feature [331]..[331]: n is a, t, c or g
aattattataaatgctatttactggttttcaattcttatgaccaacttagacaaaacaaagaaaacttcattatagtcacagaacataaacattatacattttgacaacacaaaactgatatactcctaattctcaaatgaaaataaattttaaggtggcagccacagatataaaggaaattaattaaaatacgattccatgttaataagctagaaagtattgataaaattgatggtatttctaagagactataatgacaaaatcagcaaaagaaaatctaaatagaatactaattttggaaaatatttggaaagaagtctaacaatatcncccactgaaaagcactgtatttgcatagttttgtaaatgaatactttgaaacttcattctctgaaatattctttttttgttttcttctttttttttttgagatggagtttcgctctgtcgcccaggctgggtgcagtggcgtgatcttggctcactgcaagctccgcctcctgggctcacgccattctcctgcctcagcctccagagtagctgggacttcaggtgcacgccaccacgcccagctaatttttttgtattttttagcagagatggggtttcactgtgttagccaggttggtctcgatcccctgacctcgtgatccacccgcc

SEQ ID NO: 1746 - DNA, 661 bp, Homo sapiens
  misc_feature [331]..[331]: Chromosome 22, SNP identification no. = rs11913109
  misc_feature [331]..[331]: allele = a, in linkage disequilibrium with rs431319, respectively
  misc_feature [331]..[331]: n is a, t, c or g
gaccagcatggagaaaccccacctctactaaaaatacaaaatttagctgggcgtggtggcgcatgcctgtaatcccagttactcaggaggctgaggcaggagaatagcttgaacccaggagacgtgagttgtggtgagccgagatcgcgccattgcactccagcctgggcgacaagagtgaaactctatctcaaaaaaaaaaaaaaaaaaaactttcaaattaacattcaattttaatggaaaaagtctagaatataccttaaaataaaaaacaagtaaaatatttatagtaactacgaggaaggaggctttcacttttcatggcataccntcctgtaatgtttcaatttattagttttgagcatcctttttttttttttttgagacaaggtcttgctctgtcacccaggctggagtgcagtggcatgaacgtggctcaccgcagccttgacctcgtgggctgggaacacaggcacaccacagccatgcctggttaattttttagtttctatttttagtagaaatgggctctcattatgttgcccaggctggtcttgaactcctgggctcaagtgatcctcccaccttggccttccaaaatgctgggattacaggtgtgagccacctcacccagcaataactgtcttgtgacacaaacagg

SEQ ID NO: 1747 - DNA, 661 bp, Homo sapiens
  misc_feature [331]..[331]: Chromosome 22, SNP identification no. = rs11912450
  misc_feature [331]..[331]: allele = a, in linkage disequilibrium with rs431319, respectively
  misc_feature [331]..[331]: n is a, t, c or g
atgcctggttaattttttagtttctatttttagtagaaatgggctctcattatgttgcccaggctggtcttgaactcctgggctcaagtgatcctcccaccttggccttccaaaatgctgggattacaggtgtgagccacctcacccagcaataactgtcttgtgacacaaacaggtggattggtgctgtcatcaataataattgtgactaattagctcatcaggtcctaggatggctttggggcagcagttggtgcaacttctggtaacttctgtcatcaaactctggttatgtggatgtctctgagtcatatcaatgtagtagcctctnctgagtaggaatggtatttgtgtgtctctgggtctgaatccctcgtgaaactataagctccttgagggcaggtattatttctcattgctcttagcaagtcacctgttgtttggcatacccagctgtcctctggagactgtcctttactttctgcatccacatagctatagtaggagccaccatatttgcgcaacatggccctaccaatggctgctgttgactggactggagatagagcccatcttaagccaagccactgaaagcctcatggccccactcatggatgttgttgattggactgtgggtagggtccaacccaagctggaccaa

SEQ ID NO: 1748 - DNA, 661 bp, Homo sapiens
  misc_feature [331]..[331]: Chromosome 22, SNP identification no. = rs1210599
  misc_feature [331]..[331]: allele = g, in linkage disequilibrium with rs431319, respectively
  misc_feature [331]..[331]: n is a, t, c or g
atctgtactaagaaaaattgttttgccttgagatactgttaatctgtaactttagccccaaccctgtgctcacacaaatatgtgctgtatggaatcaagctttaagggatctagggctgtgcaggatgtgcctggttaacaatatgtttgcaggcagtatgcttggtaaaagtcatcgccattctcgattaaccaggggcacaatgcactgtggaaagccacagggacctctgcccaagagagcctgggtattgtccaaggtttccccccactgagacagcctgagatatggcctcgtgggaagggaaagacctgaccgtcccctagcccnacatccataaagggtctgtgctgaggaggattagtaaaagaggaaggcctcttgcagttgagataagaggaaggcctctgtctcttgcatatccctgggaatggaatgtctcggtgtaaaacccactagtacatttgttctattctgataggagaaaaccaccctgtgcctggagttgagatatgctggtggcaatgctgctctgttactctttgctacactgagatgtttgggtggagagaagcataaatctggcctacgtgcacatccgggcacaataccttcccttgaacttatttatgacacagattcctttgctcacatgttttc

SEQ ID NO: 1749 - DNA, 661 bp, Homo sapiens
  misc_feature [331]..[331]: Chromosome 22, SNP identification no. = rs444204
  misc_feature [331]..[331]: allele = a, in linkage disequilibrium with rs431319, respectively
  misc_feature [331]..[331]: n is a, t, c or g
aagaggaaggcctcttgcagttgagataagaggaaggcctctgtctcttgcatatccctgggaatggaatgtctcggtgtaaaacccactagtacatttgttctattctgataggagaaaaccaccctgtgcctggagttgagatatgctggtggcaatgctgctctgttactctttgctacactgagatgtttgggtggagagaagcataaatctggcctacgtgcacatccgggcacaataccttcccttgaacttatttatgacacagattcctttgctcacatgttttcctgctgaccttctccccactatcaccctgttcacctgncgcattccccttgcggagatagtgaaaacagtaatcaataaatactgagggaactcagagaccggggccggtgcgggtcctccatatgctgagcaccggtcccctgggctcactgttctttctctatactttgtctctctgtcttatttcttttctcagtctctcgtcccacctgacgagaaatacccacaggtgtggaggggctggccctcttcacaggcccctcccaaaacctggctgcatcagatctccccccaccccttcactgcttgagtcaatttgagtgagtctgttactttcagccaaaagtatcccaaggaatttagagcc

SEQ ID NO: 1750 - DNA, 661 bp, Homo sapiens
  misc_feature [331]..[331]: Chromosome 22, SNP identification no. = rs365421
  misc_feature [331]..[331]: allele = c, in linkage disequilibrium with rs431319, respectively
  misc_feature [331]..[331]: n is a, t, c or g
gagataagaggaaggcctctgtctcttgcatatccctgggaatggaatgtctcggtgtaaaacccactagtacatttgttctattctgataggagaaaaccaccctgtgcctggagttgagatatgctggtggcaatgctgctctgttactctttgctacactgagatgtttgggtggagagaagcataaatctggcctacgtgcacatccgggcacaataccttcccttgaacttatttatgacacagattcctttgctcacatgttttcctgctgaccttctccccactatcaccctgttcacctgccgcattccccttgcggagatantgaaaacagtaatcaataaatactgagggaactcagagaccggggccggtgcgggtcctccatatgctgagcaccggtcccctgggctcactgttctttctctatactttgtctctctgtcttatttcttttctcagtctctcgtcccacctgacgagaaatacccacaggtgtggaggggctggccctcttcacaggcccctcccaaaacctggctgcatcagatctccccccaccccttcactgcttgagtcaatttgagtgagtctgttactttcagccaaaagtatcccaaggaatttagagcctgagagaagtccaatgtcacac

SEQ ID NO: 1751 - DNA, 661 bp, Homo sapiens
  misc_feature [331]..[331]: Chromosome 22, SNP identification no. = rs367594
  misc_feature [331]..[331]: allele = t, in linkage disequilibrium with rs431319, respectively
  misc_feature [331]..[331]: n is a, t, c or g
ggccctcttcacaggcccctcccaaaacctggctgcatcagatctccccccaccccttcactgcttgagtcaatttgagtgagtctgttactttcagccaaaagtatcccaaggaatttagagcctgagagaagtccaatgtcacactgcaggccaatgaagaactatcctctttctgctgactctcaaacgcaaagttctttggggcaagaaagaaacaaggaagaaaaaaatcactcacatctgttgaagacttactatgtgctaggtattttggaatgtcatttatttaatgtttaccatggcagaaggtagattttattctattagnttacagataaggaaactgaggctcagatatgttgaataacttgtctagagaagaaatggggattatatttaattattttaacaaattccatgattgtcagttacctcctgttgcttttttttttgagacagagtctcgcactgttgcccgggctggagtggagtggcacaatcttggctcactgcaacctctgcctcccgggttcaagtgattctcctgacccagcctcctgagtagctgggattacaggcatgggccaccacactctgctaattttctattttaaatagagatggggtttcaccatgttggtcaggctggtctcaaact

SEQ ID NO: 1752 - DNA, 661 bp, Homo sapiens
  misc_feature [331]..[331]: Chromosome 22, SNP identification no. = rs431319
  misc_feature [331]..[331]: allele = a, g
  misc_feature [331]..[331]: n is a, t, c or g
ctttcagccaaaagtatcccaaggaatttagagcctgagagaagtccaatgtcacactgcaggccaatgaagaactatcctctttctgctgactctcaaacgcaaagttctttggggcaagaaagaaacaaggaagaaaaaaatcactcacatctgttgaagacttactatgtgctaggtattttggaatgtcatttatttaatgtttaccatggcagaaggtagattttattctattagcttacagataaggaaactgaggctcagatatgttgaataacttgtctagagaagaaatggggattatatttaattattttaacaaattccntgattgtcagttacctcctgttgcttttttttttgagacagagtctcgcactgttgcccgggctggagtggagtggcacaatcttggctcactgcaacctctgcctcccgggttcaagtgattctcctgacccagcctcctgagtagctgggattacaggcatgggccaccacactctgctaattttctattttaaatagagatggggtttcaccatgttggtcaggctggtctcaaactcctgacctcaggtgatccacccaccttggcccccaaagtgctgggattacaggcatgagccactgcacccggccccatattgcctcttaa

SEQ ID NO: 1753 - DNA, 661 bp, Homo sapiens
  misc_feature [331]..[331]: Chromosome 22, SNP identification no. = rs448041
  misc_feature [331]..[331]: allele = g, in linkage disequilibrium with rs431319, respectively
  misc_feature [331]..[331]: n is a, t, c or g
gttgcccgggctggagtggagtggcacaatcttggctcactgcaacctctgcctcccgggttcaagtgattctcctgacccagcctcctgagtagctgggattacaggcatgggccaccacactctgctaattttctattttaaatagagatggggtttcaccatgttggtcaggctggtctcaaactcctgacctcaggtgatccacccaccttggcccccaaagtgctgggattacaggcatgagccactgcacccggccccatattgcctcttaaaaggtgtgctatcagcatgaggctgttgaaagataataaggtagccagtgagnaccctaggaggaaggtgactagtacgttggcagtcagcctcttgaaatcttgtagagtacagacagaaccaagagttgagacagccatgtctcccccacattttaagaccattctctttctagaactcactcactgccttctggttgctttaggactcccagtacccacccagacagccccagctccagcctctggagacatctccttagtgggttctctgcatgcccttccatccttgggaaaacccagaacaaaaccagatcttccaacagaggctctgcaatggaaaaatcccaggggactgaggtgcatgatctgctttggagcac

SEQ ID NO: 1754 - DNA, 661 bp, Homo sapiens
  misc_feature [331]..[331]: Chromosome 22, SNP identification no. = rs6005623
  misc_feature [331]..[331]: allele = c, in linkage disequilibrium with rs431319, respectively
  misc_feature [331]..[331]: n is a, t, c or g
ataaggtagccagtgagcaccctaggaggaaggtgactagtacgttggcagtcagcctcttgaaatcttgtagagtacagacagaaccaagagttgagacagccatgtctcccccacattttaagaccattctctttctagaactcactcactgccttctggttgctttaggactcccagtacccacccagacagccccagctccagcctctggagacatctccttagtgggttctctgcatgcccttccatccttgggaaaacccagaacaaaaccagatcttccaacagaggctctgcaatggaaaaatcccaggggactgaggtgcangatctgctttggagcactcagggatatctgtctcctcacactgggctggttgtggtgaagggtgcaccgggctcttttaatgtacacatctggattgaactgagattcccacagcagatttcctaatggtgagtggaggacaacagataaataaatataattaggaacagtatccagactgacgcatgctgaagagtttcagcaggtaccaacagatatattcaggagtcagagaagcttgggaaattcccatagtcataaattgtaatctccgggtcaagttagctgaccatcagaaatcatcctggcaggtcttttaacactgcagtt

SEQ ID NO: 1755 - DNA, 661 bp, Homo sapiens
  misc_feature [331]..[331]: Chromosome 22, SNP identification no. = rs9306459
  misc_feature [331]..[331]: allele = a, in linkage disequilibrium with rs431319, respectively
  misc_feature [331]..[331]: n is a, t, c or g
ctgcaatggaaaaatcccaggggactgaggtgcatgatctgctttggagcactcagggatatctgtctcctcacactgggctggttgtggtgaagggtgcaccgggctcttttaatgtacacatctggattgaactgagattcccacagcagatttcctaatggtgagtggaggacaacagataaataaatataattaggaacagtatccagactgacgcatgctgaagagtttcagcaggtaccaacagatatattcaggagtcagagaagcttgggaaattcccatagtcataaattgtaatctccgggtcaagttagctgaccatcanaaatcatcctggcaggtcttttaacactgcagtttcctgagcctgacttctgaggattctgattccataggcctgtggtgtatttgtcattttgagaagcctccagggggattctgacaactggccaaacttagagagattcacaaggcacattgtcacattaaaggcactgaaaagtcctgtaataatgacacccacatcatttcactgaaccagtttatcaaagttacttgaacacagatctctccctctatatattttgtacacctgtttttacaaggtctactgctcagggagcttgccaagatttcctcttaataattctatact

SEQ ID NO: 1756 - DNA, 661 bp, Homo sapiens
  misc_feature [331]..[331]: Chromosome 22, SNP identification no. = rs9608693
  misc_feature [331]..[331]: allele = g, in linkage disequilibrium with rs431319, respectively
  misc_feature [331]..[331]: n is a, t, c or g
tggtgagtggaggacaacagataaataaatataattaggaacagtatccagactgacgcatgctgaagagtttcagcaggtaccaacagatatattcaggagtcagagaagcttgggaaattcccatagtcataaattgtaatctccgggtcaagttagctgaccatcagaaatcatcctggcaggtcttttaacactgcagtttcctgagcctgacttctgaggattctgattccataggcctgtggtgtatttgtcattttgagaagcctccagggggattctgacaactggccaaacttagagagattcacaaggcacattgtcacantaaaggcactgaaaagtcctgtaataatgacacccacatcatttcactgaaccagtttatcaaagttacttgaacacagatctctccctctatatattttgtacacctgtttttacaaggtctactgctcagggagcttgccaagatttcctcttaataattctatactaatatcataaatccaggtttttttatgtctttcctaccattttgtagtatccactggctgttctctccttgaaggcaggaatagtgtctgttttatttgcaatatcccttatgcagagtctgagtaaatgagtcttttaagataatctctgaacaggggat

SEQ ID NO: 1757 - DNA, 661 bp, Homo sapiens
  misc_feature [331]..[331]: Chromosome 22, SNP identification no. = rs6005625
  misc_feature [331]..[331]: allele = c, in linkage disequilibrium with rs431319, respectively
  misc_feature [331]..[331]: n is a, t, c or g
caacagatatattcaggagtcagagaagcttgggaaattcccatagtcataaattgtaatctccgggtcaagttagctgaccatcagaaatcatcctggcaggtcttttaacactgcagtttcctgagcctgacttctgaggattctgattccataggcctgtggtgtatttgtcattttgagaagcctccagggggattctgacaactggccaaacttagagagattcacaaggcacattgtcacattaaaggcactgaaaagtcctgtaataatgacacccacatcatttcactgaaccagtttatcaaagttacttgaacacagatcnctccctctatatattttgtacacctgtttttacaaggtctactgctcagggagcttgccaagatttcctcttaataattctatactaatatcataaatccaggtttttttatgtctttcctaccattttgtagtatccactggctgttctctccttgaaggcaggaatagtgtctgttttatttgcaatatcccttatgcagagtctgagtaaatgagtcttttaagataatctctgaacaggggatgtggccctctgcctccccggttcaatgaagtactttgataccagggtggaagagagatttaaagcagcatgtcatagtaggaa

SEQ ID NO: 1758 - DNA, 661 bp, Homo sapiens
  misc_feature [331]..[331]: Chromosome 22, SNP identification no. = rs5997305
  misc_feature [331]..[331]: allele = g, in linkage disequilibrium with rs431319, respectively
  misc_feature [331]..[331]: n is a, t, c or g
tccaggtttttttatgtctttcctaccattttgtagtatccactggctgttctctccttgaaggcaggaatagtgtctgttttatttgcaatatcccttatgcagagtctgagtaaatgagtcttttaagataatctctgaacaggggatgtggccctctgcctccccggttcaatgaagtactttgataccagggtggaagagagatttaaagcagcatgtcatagtaggaaaggctgcagagccacttttggttgacagtcatggatgatgagtgccagcagtccagctccttctcctctgagctgtttctccactgctctgagatcancctcttaacaaacttggtccccaggtaaaagccctcctgagacatttggttaagaagaggagtttcccatttctccccttctcctttcagccaccaggcattgaagggagcagtgctgaggccatttaaatgggcttctccatagaatgggcccttctgttggaaactgggttatgcacaaaccattcacaatggctttttacaccccagaagcactaagatccccctaatcttcagtcaaaacagagcatgaagggtggggtattcatcccaaaggcactgggcatctgaaagttagggaggggtgggaccacccacattcagggcttt

SEQ ID NO: 1759 - DNA, 661 bp, Homo sapiens
  misc_feature [331]..[331]: Chromosome 22, SNP identification no. = rs1210606
  misc_feature [331]..[331]: allele = c, in linkage disequilibrium with rs431319, respectively
  misc_feature [331]..[331]: n is a, t, c or g
tttctttttttttttttttttttgagacggagtctcaccctgtcgcccaggctggagtgctgtggctcgatctcggctcactgcaatctccagctcccaggttcaagcgatcctcctgcctcagcctcctgagtagctgggattacaggtgcctgccaccacacctggctgatttagtaaagatggggtttcaccatgttggccaggctggtctcgaactcctggcctcaggtgatccgcctgcctcggcctcccaaagtgctgggattataggcatgagccactgcgcccgacagtatattggttttctatttctccataataaataacnacaaacttagtgactttaaacaacacccctccattaggtcatagttctgtaagttaacaggccaggtatggcctgattgtctcctcagtgtgtcacaagtttaaagtcaaggtgttgctgaggctgtgatctcatctgaggctcagggttctctttcagactttttccagttgttggcagaattcagttagttgtggttgtaggactgaagcccccacttccttgctggttgttgtccaggaaccacttttatcttttagagaccacactcaaagtccacaggcaattcacagcatggatgtttgctccttcaaggccagcaggtggctg

SEQ ID NO: 1760 - DNA, 661 bp, Homo sapiens
  misc_feature [331]..[331]: Chromosome 22, SNP identification no. = rs406160
  misc_feature [331]..[331]: allele = a, in linkage disequilibrium with rs431319, respectively
  misc_feature [331]..[331]: n is a, t, c or g
tgcctcagcctctcaaagagatggcaaagatcccaaagattacaggtgtgagccaccgttcccggccactttctcactttcatcttctgttgttgctctcctttggctgatcttaacatgaagctgagtaagggagccagcttattgatgcagtcagtagaagccagcttcccagggagatccaggttgggggaatatggagtgtggatcaggagaggtaaggagatgatatttggcaaaagtacttcttagagtcacacatcttgtaatgatagacctcagattcaaattcaagtctgtttaaagtcaaattataccatctatgcatccntccatgcatccatccatgcatccatccatctatccatccatccattcttccatttcctgagtgcctactgtgtggcaggcattctgctaacctaacaacccagtgagagacatacttatattcctattttataaaggcccagagaggttaagtaaataatccagagtcacacagccagggagtggcaaagctagaattcttatttaattccaaacttgatttctaccctctccaccaccaaccacccatatatatccactgaccaacctattcattcatcagacttttactgcatgtctcaagtaagctatgcactgtgtttagagctga

SEQ ID NO: 1761 - DNA, 284516 bp, Homo sapiens
  EIF4G3 gene - 20878278 - 21122793 of chr1; NCBI Entrez Gene ID: 8672; Build 35; sequence includes 20,000 bases upstream of initiation codon and 20,000 bases downstream of termination codon of the gene
aacctattgtatgcagggtatgagggggtggtagcggttgtacctactctcaagaaatggaatgaaatataataaaatgaacttactagacaacaatatcaattagtccactttcaagttctttggaagtttctttttacacttacaaaaagattcagtctattattactagttaagaattattattgtgctgtcaagaatgtttatggaatgtcagtttacctttgatattctaaaactgccctctcttcagtttttgggtggttccaatttatattaattgacatatctgaaacttagcaaaaagaaggtagtttgttttttattttatgtttgcacatacatgtttggctcttaaaatgttagtaggttatatagttcttttcattaaggagttttaaaaaattaatagttaagaagaatgtagttatatctacaccatgaagtactacttaaacatttagaacaagaatgaagtaggtatgtttattgacttggaaagatctctaatgttttgataagtggagaggaaaacatgtcattgaatatttattattgtgttgttgctattatttttacacatttgtaagtgtatagaaaggtttgtaataatgtgcttcagagtattaatcattttgccatagggagtggagtgggatttgaagggtaaagagggcactactttttcttttttttaacaaaaatcatgtttatacattattgtagcaattagagaaagtaagcatcaaactttttttttccacagtcttagttgccactgcctgatatgcaaattggtaataattctatcctgattcaatcactagatgcaaatggttttccacagtggccttaaaattttcctagattattgaaaaataatattgtattagcagtaataagttgtggcttgccgttttcctttgtggtcttaaatttatttttccaaaattttaatataggacagttagctgagttcaagtcttgcattactttgaaagatcatctttgactgaattctataatgatttataagataaccatgattgagtatatttcatttctctattcttcctgtgctcaccttttacgtaaaacaacaaaaaaaatctcattcttacccatgattagctcatcctcttttctttcgacaaacctcacagtcagtgtcatcaaatatttgtgaaatccagatgctgctgctgctttcctaccccctcctctcccccggtaaaaattcctacgagttagactcagtcttttttctgtttggcctttctttctaaatagagaacagcctttcctgttgtgacagcctaaaatgtgtttgaagttacttttctgtgttttcctaagtacaaaataactgaaagatcctctggcctcttggagcttgcttttccaggggactaaacattggagatgttgcagagcttttaagaatattgagataaacttaatttagaaaacatatattgaatgagagctatatgcaaggttttgtgcctggtaatgtgagaaagcagtggtggacactatgatccttgtctttaagagtgctcattttaccaggcaagatggtgatacgttgttttaagtacatgtgggaatgtgaggaagagacattaatgattatgtaaatgagaacaaaaatatgtaaataagtagtaacatttactggtatagtttttctgggttctcattaagcaaaagtacttggaggagtgaagcatggttaaacagagaaagatggtatctagatgaactctaagaagccataaaatgtaggtgggcagcaagtttggactgcatcttacaagatattggaatgagtgtacatacatcagttaaagcctttgaggtggaggataaggttacagctacatagtgtaatgagccatgaaatagataacaaaaattgaccaaacctaggcagaggagttaactggtgaaaaactcaacagaacagtttatacaggttgagcatctctaatcaaaacattcaaaatctgatatgttctaaaacctgaaactttttgtgtaccagcattattctcaaaggaaatgctcaatggagcagttcagattttggattttcagattgggggtgctgaactggtaactgtttgcaggtgttccaaaatctgaaatctgaaacatttctggttccaaatttttcagatagggatactcaatctgtagaacattttctttattactataagtaacacttactgtgtaacagttacttttctaagcattttatgtgtattaactcaatccttatgacaactgtatgaggtaggtataattacattccccattgttagttggcaaatagacacagaggtgacgtatcctgcccaaagttatccaggtagtgtgtggtagaggttggatttgaactttggtggatcttttaacatttattgagtgactacagtgtcccagacactgtgctaaatgctttacattcatgatattatttaatacttatgacaacctttatttacaacaaaggaaaatgggacttggagacatgtaatttgaatacaggtctgttttgaatctacaagttcatgtgaagtattctgtttttttttttttttttttttttttaaagacagagtttcactctgtcgcccagactggagtgcaggtgcagtggtacgatctcggctcactgcaacctccacctcctaggttcaagcgatactcatgcctcagcctcccgagtagctgggattacaggtgccttatgcccggctaattttttgtatttttagtagagacagggtttcaccatgttggccaggctggtcttgaactcctgacctcaggtgatacacccacctcggcctcccaaagtgctgggattataggcatgagccactgtgcccggacccttctttttgttaagatcacaaataaggtcaaaagcaatactcaatttttgggggattagggcccttttgaaaatctgatgaaaggtatgaatctactttgcagaacagtaaacatacaaacataggggttttctttttttattttattttttgtttatttatttattttttttgagatggagtctcgctctgtcactcaggctggagtgcagtggcgtgagccactgtgcctggcctctttttttattttttaactgcagttttaagagagttcaataactctcactgataagattccttattctagtctagacagattttccccttgcagtggtgctgtgttgcactttgaacctgattcctaggatttggaaatagctcaacttcgactttacggtgtattaaatggagaggtatcttattaagattttatttacccttctattttgaagtatttttcttaaaaagcatttatacatgtggtactcagttgtattctggttattaaaaattttatgtctttttctacccatcatggtatctgcttgctgattaataacatttatgaaagttaggattccttgttgttaatatttaatgtgaatttgctcattaaatgttaaatcagataccttgttaaaatattatttaataaaagccagacgtggtggctcatgcctgtaatcctagcactttaggaggctatggtgggcagatcacctgaggttgggagttcgagaccagcctggccaacacggtgaaaacccgtctctactaaaaatacaaaaattagccaggcatggtggtgggcacctgtaatcccagctgttcgggaggctgaggcaggagaatcccttaaaccccagaagcagaggttgcagttagccaagatcatgccattgcaatccaccctaggtgataagaatgaaactccgtctcaaaaaaaaaaaaaaaaaagaaaagaaaaaaattacttaatatgtatttacctgattacttttcttcaaaagaaggattaaccttaaagatacaagggtatgttattttgttaaatgccagttataaatgtcttttgaatttctgggataagaaaacagtagaaataataataaagttctttaatgtttgaaaactgaaaatgtgtttctttgaactgtgggatattcccttcacagcaattttacaaagtatatgtactgtttttaaaaataaaacaactgatatggaccacgtttaactaaaatgagtcataggaaattagattttaataactagttgtgtggtaaatggagttttaattattttaaggaaaaggaaagaaagaccattagtatctccaggcatggatttattattgccatgaagttgttgtcatgaatagaacgatcagtttttactgtaaactttgatagacactggagcatttaacttcaactttatacagttccctttttatcttttaaaagcacatctggctgtcgggaattctgtaggcaagaaattgtgaaggattagaaactgttctttgtgcatttaaactgtcattctgtggttgcttaattgccatatagaatgcagaatactagattagaaaggtgtttagtttctttagctgttacagatcccaaagaacttttgactctgttaatttcttatggctataacatttctatgttaattttttacatatctaatgtaaaatcaatggtatattgttattctttgttcaataagcatttgtttagtaactttattttttttaatgtttttatattttttactttttttttttttcctccaggagtggactgagtctgatgaggctgcagggcctggcccctcatccctccccctcccgccataactctttaaaaaattcagaaaaatcaattaggatgaggtgtcaagtatttagttatttgttattattaattttcttttgagacagagtctcgctctgttgcccagtggtatgatcatggctcactgcagccttgacctcctgggctcagttggccctctcccacttcagcctcttgagtagccacaacctctggctaatttttgtatttttattagagacagggttttgccatgtttcctaggctggtcaagtatttattttaaacttgcttaaaggattagactttgcaaaccacagctttaggtttattgtaacactctcacccccatttgtataaatgaaaatcaagcaggaatcatttcaccccaaaactgtcttacacttactggcttaatattaggattttaaaccaacagtttaaatatttgtaaataattaaacacactttttatatactaggcattatgataaatattatcttaatgtgttgaataaatcagcatgataagtccttacttttcacttttacagaagaggaaactaaacttaagtaatttgcttatatagtttctgtatagtagagccagaattcaaacttaggtctctgacaccaaaacccattctcatttttttctttttttcttccccccgccgccccaccactgttttttttttaagatagagtttcagtctgtctcccaggctggagtgcagtagcatgatcatagcttgctgcaacttctgggcttaatccttctctcccagcctccctagagctaggactacaagtgcacaccaccatgctaaatttttttttttttttttttggtagaaacaaccccatgctcttttattgatgctgtttagcctacttggatgccttgaatctgtttaccttctgtttatgttccttctttcaagtttgtgtttggaaagtgataattcgtgactcagcctcagaatggaggcatatatcacacatcttacatgatttggatctgtgtcagaggaacttaatattgtggttttgataatataattgaatttatgcttatagttgaatactaaaatctgagatttattaataccttggaattaaaatagaattcacttaccttggatcagttaaataactagttgattagcaactgactgaagatcaacaggaaaatagtaaggcattagttttaaaaaattaagttgtaagttggtaaatgactaattccattgcagtcactgaatgtatatcagtaatctccagactcgcatacaaccttgtcttggtggaaagctctgactatggattttgaacataagaaagagaatgtgagtgtctgttaaaagccatcactcctcagatgatgttaaaagtcttcactccacatcttctgaggagttgtcaagtgttcctgcttctgaccacaaggacagcaattggcctgtaatatatgtattccttgaaaaagtaaggagttaatttgttatgcttgtgtagactgttactaattttgtgtagttttactaaatgattggatttagtagaatagacaaaccttaccactctttttttttattcaagacagtcattcctaactgatcaaggttttgctgttgaactgggaaaggaccttggaatcataatatagtgctacacgattctattagcagtgaaagaaataaaaatgtttttactatcttggcttcctccctttacgctgtaaagcagccctggctacctgatgtcttcatgagttgatattctaaataattttaccctcaaatagccatataatagtaagatttggttgaattagtaacagagaaaatatttatagttaaacatctgagtggccacttgtctgcaagtactgtcataagtactcattaaatcctattcctgtccacaaggattgcaagggcgcaaacagatgataagaatcagtgatcactcactgattgtgtccttgcagtctctgggtggctgcagggcacaaaggatagcatgaacctcgccattggctgcagggcacaaaggatagcatgaacctcgccatcctcaactacatcattggcttaagcaggattttataagacagtctggatacctcactgccaagttccaaatagcagattttgctcactataaaattaatgtgtctgctagaaaaatggaaacacagagaaaagtatgacaggaggctgggcatggtggctcatgcctgtaatcccagcactttgggaggctgaggcaggtgaatcacttgaggtcaggtcaggagttgcagaccagcctggccaaggtggcaaaaccccatctgtgataaaaataccaaaaaaaaaaaaaaaaattagctgggtgtgatggcatgcgcctgtaatcccagctacttgggaggccgaggcaggagaattgcttgaacccgggaggcggaggttgcagtgagccaagattgcaccactgcactccagtctgggcaacagagtgagactgcgtccccccccccaacacccccccccccaaaatgaaaagtatgacaggaaaaacatccgtgatgttgttaacaaaagactcacaccacccattttaacgtgatccttcaagttgttttgctgtgcacttaaaaaaaaaagttattagtgcaccaccgatttctgtcctgctttctttacttaaaattataccataagcaacttctcatttttaaaacacatttttctaaatatatattttaagaatgtatttacttgttctctaatgagttagtattttttactcttacagtgttcaaacaactgtcacatagtttcttggcatccataaattttctattttttttaacgctctctcagcagaatcaatattcttttcaaaatactgcctctaacttttgatctgaacccttgttgttctcaaagtgtaagtcaggtgccaccaaacccttccagattcttctcagacctggttacttttgatttttcagcagtactttaaatacatctcctattagccgggcgtcgtagcatgtgcctgtagtcccagctattcaggaggctgaggtgagaggattgattgagcttgggaggtggaggcgccactgagttgtgattgtgccactgcattctagcttgggtgacaaagtgagacccagcctcaaaaaaattaaaaaaataaatatatattctatggtatttatcacataattcatttatgatgacagagtaggtgaaattaggaatcatatcaaactggtttggattgctgtgtggtatcctgcctatcctttatattctgtcccagcatcagcagacccattatttaaaatatatatatattggctgggcaccgtggctcacgcctgtaatcctagcactttgggaggccaaggtgggcagatcatctgaggtcaggagttcaagaccagcctggctaacatggtaaaaccctgtttctactaaaaatagaaaaaattagccaggcgtggtggcacgcacctgtaatcccagctacttgggaggctgaggcaggagaatcgcttgaacccgggaggcagtggttgcagtgagccaagattgcaccgttgcactccagcttgggcaacgagtaaaactccatctcaaaaaaataggtatatctatatctgtatctatatctatatctgtggatatatctactgcttacgtcttctccgtggtgctagatccatatcaatcctgagactactgacattggtttgattgttccttagtcaccttttgcctatattttgaaattctgagattctgactttgatttaattttagtttaggatattactgatttattctctgatgatcttgtttattttcttttagaattataagcagaggctaggagtagtggctcatgcctgtaatcccagtactttgggaggctgaggtgggaggattgcttgagcccaggagtttgaagccagcctgggcaacatagtgaggccctgtctcaccaaaaaataaaacaaattagcccagtgtagtggcacacacatgtagttttaactacttgggaggctgaaacgagaggattgcttgagccctggagtttgaggttgcagtgggctatgatcgcactactatgcttcagcctgagtgacagagcaagaccctgcctcagaaacaaacaaacaaaaagcaagcagagagactgggtgcggtggctcacgcctgtaatctcagcactttgggagtccaaggtggatggatcacttgaggtcaggtatttgagaccagcctggccaacatggtgaaatcttgtcctattaaaaatacaaaaattagccaggcatggtggcatgtgcctgtagtcccagctacttgggaggctaaggcaggagaattgcttgaaaccaggaggtgaaggttacagtgagccgagatcgcgccactgtactgcagcctgggtgacagagtgagactctgtctcaaaaaagaaaaaaaaaaaaaaaaacaagcagagaaataaaccatattgattacataatgagagtgagcacaaccttgagtatgtaacaattgacattgacaaaattgatccagaaataaattttagctttgccttttgccatcttcctctcataagtttcagactttttcatctgaaatttgctagttttgataattagcttagatgctatgtggaatgttggtaatgaacctacctctagatttacttgcttggccctgactgctctcctgagcttagattcatgtattcaacacactacttattatttccatttgaatctctgataggcatctaaaactacttgtggttatccctttccctttgtctattctgcctctaatcctgtctcacagtaataacaggttgaacatcccgatccaaaaatatacaatgcttcacaatctgaatgttttggagtgccaacatgatgctcaaggaaaatgatcattagagcatttggattttggatttttggattagggctgctgaagtggtacagtgcatatattcaaaaattaaaaaaaaaacctgaaatacttctggtaccaagcattttggattaggaatactttcccttcttcccacctaatctttcaagccataaacttaaaatccatccctgatatccataatctatcactttcaagtatactatataatttatttaagtattatggctgttagtatttcagctagaccataaactccaggaatgcagggattttagtctcttttactgatgtattccatgcacctagtacaatgcttggtataaagttctcaataaatatatgttaaatgaatgaatgaatcaatcagtctacattcctttctgttccacctgctcaaacaaagtatcttgttactaccgtgttctaagccaccattagttgtggccaagatgattgcagtagctttgttttttttttttttttttttttcttaagagacaggatcttgctgtgttgaccaggctgtgatgcagtggcttttcacaggcatgatcatggtgccttacagcgccgaactgttgggcctcttgccttacgctcccaagtagctgggactgcagatgtgagccactgtggcctggcatgatagcttttaactaatctctgcttctattcttgtactcttcagttcttattcttacaaagcaaccaaaatgatctttggaaaacattcgatcttttcacactcctgcttttaaaacttccagtaggttcccagtcatgttagaataaaaccctaagtccttaccatgccaacaaggacttaaatgtgtgttgttttaagctgttaagtttgtgatttgtctcttgattaattcagataactgataaattacctagccagatcagtgttaccctattatattcactggcaccccttattcttcagaggagggaattattcagggtgtgtacaccaagtacaggaatactgagagccatcttagatttgagtccaccctggctggatgcagtgacgcacgcctgtaatttcagcactttggagggccaaggcaggcggaccccttgagcctagaagttaagaccagcctgggcaccatggtgaaatcttgtctctacaaaaaataaaaaattagccgggcatggtagtgcatgcctgtagtcccagctactcaggaggctgaagtgggaggatcacttgagcctgggaggtaggtggaacctgcagtgagccgagatcgggccactatacacctgcctaggtgatacagaccctgtcttaataaaaagagtttgccctgtggccctcaaggattcacatagggtccactttcgttaacctttgatacctagacatttttggaagtgcttctttcttattcgtttattttttcatttgttagcattgttactgaccctccaattttaacaacattttcttgtttctattggatagttactaaataagaaaagcaaccctcagaattaaacccagtgctgacaaagtccatagtagaacatacatggtatgtgtttgcttgagtttttaagtattacttgaatcatataaaattatttttcttttttaaggttaaaatatacttgaatatctgtaaatctggaatttcatgtaattcaacctattaagtataggtaagagtagagcaaggaggaatgccattttctttttctttctctttttttcttggtggttggggattggcaatgatattaacagaattcaaatggtgtcatgtataagtaaaacttccttcctcatatccactgtagtgctccttttagttgagcagaccagcttttatttagttctcaatatctgtagatttggggaaataaatgacctgaaggaagaactaggatgatacaaaatattaatgaagggaaaaatacttgacttatctattctgctgcttgaggagcataaagtatagaaattacccacataagaaaagctttgggatctttcaaaactacccagaattgaactttgttatttctgtgtatgagttgcagctgctgaaatgttttgagatgacctcactaaataaactttatcttgggatttagaaaataagggatgtcacacatataaaccatgtgccttttacctttataggaatcatttgttgctgaaaaattaatttacttgataggaatcctggagtttcctgttattcttttagtaactgattaattactatactttttaaagcagtatgttttcattcatattatataaaatatatagaataaaaacagtggtttgtgtgtgtgttatatttaacaatatatctattcagtcaatgcctgtttgtgtagaatccagtcacaagtctatatctgagtatttatagaaagtttggccaggtgtggtggctcatacctataatcctggcactttgggaagcggaggtaggaggatcacttgagtttcagagtttgagaccagcctgggcaacacagtgagaacttgtctctacaaaaaaaaaaaaaaaaaaaaaaaaaaaaaagagagagagagagaagaagaagaaaaattactgggcatggtggcatgtacgtgtagtcccagctactgtggaggctgaggtgggtggattacttaagcctgggagatggaggctgcaatgagctgtgatcacaccaatgcaccccagcctgggcaacacagtgagacccgatttcattaaaaaaaaaatgaaaaagcaagtttatatttgatgatgatcatgagatacccctagagccatgtccacactctggctgcctgtgtttttaatataccaatatatggtttatttggcttgtagtgtgtatgggaagtcaggacaatttcatgcagaaagccttatttttggttactcttgaaaattttgaagaagtagcactgcttatctggaattcctgcatgccagtacttgactacaggagagtatctcagtatctgctgccctctggggagtggccattctcttatcgttttccatagtccctaatctctgttgtttacatctggccagttttttcccattttgtttcctccagggggtatttctcttgctctggagtcatgtaagaatgatcatgttaaggaaactttgttttccatattttatttattatttgaaaattgtggtttatgtatgatagctcttaattggccagaatataatcaaatccaataagttagtgctagataaataaactttatacctaatgactaatcctaatttgcatgatctttatggtctaccttaaatttttaaaaaactctgtcaagttaatattggtcaccaaccaccaaatatcattaattttataggagattattttttggtggaaatcttgaatgaaaattcactagctacctgaagtttccactgagtcaaaattttagagcttttctttcttgcagcagtatttctttttaaattttctttcttctatgcagagtaacagtataataccaatgtaagtgatattttatcacaggtgttagtagtttgcttgtttttgtctttaatcttgtttttgaggtaggtggtgtggaagaggattaaaatacacgttcatataagtacataaaacttaaaggtagagtttaacaaataattttaaagcaaaaaaaaaattttaaaccagctttaaaaaaatcacatgccctttctgtcataatttcctctctccccagaaataatactatctgccttttaaaagtcattttcctgcttctctttatagtgttgctaaacatgtgtacatctattgactaatacggtcaagttttgccggttttggatatttggataaatggaatcatactttatatattcttcttaatcttttactcagtaccatttgtgagggtcatctaaattgtgttatggtagttttttattctgtttctgtataggaaaattttcagtgtatgaaaatttcattattgatcaattctgttaatgaacagttgggttgtttccaatttttggttattaaaacaatacaactatgaacatttttgttcatgtaccctggtgcacgttttcattgttttcaaccagaggtatacctaggagtggaatggctgggtcatagggcatgactgtttccaagcttaccagctactgccaaattgcttcccaaagtggttgtaccagtttacatttctaccagcaagagaatgagaattttggaagccccacattgttaccaatgcaaaaatataatatctgtaagaagcaaaaatgtttctcgggcatattttcttttaaatgcaataagcagtacacacaaacatatattgcactacaagaaatggttgatgtattttgcttaggattaatattatagaaaagacaacagtctgtttagctttggaggtagttaagtagttgctgttttcagctgttctacacctctgctccctcccagccttcataattgagaaggtagcaatatctttcaaataatgggaaaacgtacttgttttctttgtatgagaacttgttgctactccctttaaagaagatggatttcaacagtatgacctgaaattgaacagtttaccaagagagaagaacccttagctagataatagaggattcagtaatcattaatttaggaatattttgcaagaggtatttaaattttagtgtaaatttgatttttatctatgacaattttattagcctttgtgccatttctttgggataggattgtgctatttctgttctgtataatttctagtaaaagatggtatacctttttccctggcagagacattaagccctgtaacaaatacactaaaagcgaatatggaatgcctaatgcagtgtgacatatgtaatagaggatcttatttgaattgaatagagcacagtgaagctgagagatttttattatatgtaacagcctgtttctaggaagaatttcttagaaattctagttcttctattattttgatacagacttattttctttggcctgcttttattagtagacatccccaaatttaggaggaagtgcctttttagaatatctgataccaaaggattaccagtttggcagaactatttagagttgcaaaggatgcataccatagggatatacccctgaaagttgtttttcattggtgtttcctttaaggaagctttttatgtagaaagaacagcactttaggctttggcacaatgctttttctctttctctcaaacatttgtgttttatggggcaatataatagttttctgacaaaccaatggatactaattttatgtgtaataatttaaattgttctttcagtattctttagtatatgtcagtacctctttacagttctgtaagaaacatagcttacagtctttacaactctgcagatgtatttttcctttattattcctaattatttcatatatttctgttgatactagtgtacaggtttatattttttatgtatttagttcagttgtgttacttcattttctcattggttgctatttctacctgtttttgccatcatatgaaatgcactggatatatctttaagttcctaatttttgaggtgagattttctttagggtatgtactctaaagtgaaataattttggggtgatggttttgaagcacttggtgacacattgctctgtaatcctgggaagatagtaaagtaacccattcacagtattttatctgtgtcctgtttccttagatccctgccaataatggggcaaagattttattttaacttacttttgttagtttaattgataaacatacaatgtattttaatattttttatcaatagtattttaaaaatttactatgatttaattgtcatgggcaaatttggtatttaatttttatcagaataaatcataaaactggtctaagatagattttatatagttaacttctttgctctctttttattttcactttatttcactgtacagaatttttcccgtgttaaaaatgtgtattcatattgaggtttttactttagcaaaatatcaaaataattaattctaaaacatgggaaataatataaattcataagctttgttgtaagaaattttcttataagagctcttcatttctgattattaattttctaaagtagatgtttaaatagcaatccaacttttctcctttgaaaaatttccttggtgagatttatatatgctgttacatttcatggtaaactttatgcctttataaatgtaatagtcactcaaaattggaaacaaaattttcccaagaaaatcataatcaaagttatttaaaaaacaaggatgaaactagatacaattattttaagtgttaatctttggtcatatggtagcatcatttatgtgtcttttaactcgtaagcttttggttctagttagttctgtgtgagtccatttgatttcagtattgggatcaggtagctgatcctgaagatgtttatatctgtttagagagttataagtgatttgaaggttagagtaccagggactagattttcttcagaccttttgactgagtgaattccaggccattttcctttttccctgagcagagtttttaactttatgataaaattcagaagacctatgaactgaaaatagagaatatgtctaatgatgaattttagcatttctttgcattatgaatatagacaacaattgccattagttattatttttaacgcaccactgaagaacatatattactatgtcaggaatttgtttttgtttttttctttttcttttctttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgggcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttagtacagaacaaaataaaaagtctcccatgtctacctctttctacacagacatggcaaccatccgatttctcaatcttttccccacctttcccccctttctattccacaaaaccgccattgtcatcgtggcccgttctcaatgagctgttgagtacacctcccagacggggtggtggccgggcagaggggctcctcacttcccagtaggggcggccgggcagaggcgcccctcacctcgcagacggggcggctggccgggcggggggctgacccccccacctccctcccggatggggcggctggccgggcagaggggctcctctcttcccagtaggggcagccgggcagaggtgcccctcacctcccggatggggcggctggccgggcgggggctgaccccccaacatccttcccggacggggcggctggctgggcagaggggctcctcacttcccagtaggggcggccgggcagaggcgcccctcacctcccggacggggcgggtggccgggcggggggctgaccccccaacctccctcccggacagggcggctggccgggcggggggctgacccccccacctccttcccggacggggcggctggccgggcagagggactcctcacttcccagtaggggcggccgggcagaggcgcccctcacctcccggacggggcggctggccggggggtgggctaacccccccacctcccttccagacggggcggctgtccgggcggggggctgacccccacctccctcccagacggggtggctgctgggcggagacgctcctcacttcccagacggagtggctgccgggcggaggggctcctcacttctcagacggggcggttgccaggcagagggtctcctcacttctcagacggggcggccgggcagagacgctcctcacatcccagacggggtggcagggcagaggtgctccccacatctcagacgatgggcggcctggcagagacgctcctcacttcctagatgggatggcggccgggcagagacgctcctcactttccagactgggcagccaggcagagaggctcctcacatcccagacgatgggcggccaggcagagacgctcctcacttcccagacggggtggcggccgggcagaggctgcaatctcggcactttgcggggccaaggcaggcagctgggaggtggaggttgtagcgagccgagatcacgccactgcactccagcctgggcaccattgagcactgagtgaacgagactccgtctgccatcccggcacctcgggaggccgaggctggcggatcactcgcggttaggagctggagaccagcccggccaacacagcgaaaccccgtctccaccaaaaaaatacgagaaccagtcaggcgtggcggcgcgcgcctgcaatcgcaggcactcggcaggctgaggcaggagaatcaggcagggaggttgcagtgagccgagatggcagcagtacagtccagctttggctcggcatcagggggagaccgtggaaagagagggagagggagaccgtggggagagggagagggagagggagaggagggagagggagaggagggagctaggaatttgttttaatatttttatacctgtatttcaatatagatcatttgttgtcataatcctatgtattttatgtatttaataacacgattctgagaagtctgtattttatgctagattggcaaagggtttgtgttcctctcaaatttaagaactattccttaaggagaatgacttctttcattttagcagaggacagaactgcccataattcatgaaagtttgcaaaaccatcagtgttaagtctgcattagtgtatgagagggaagagctggctaggattgattggtagacacttccactaggggtctgagtaaagtggtttcatatccgtaatgggctgatgagcaatttattgcctgcaaaaaacggagaaaatgaaatttttggttacgtaaaaacatgctgattatttttcagttgtataaatttgtgattattgtattatattagaaaatataaatgagaaaataaatacctgtaatgctttctgttaagattttggtatatctctttacagatctttaaaaatattacatatacatgtttttagatgtatgtgtgtgtattatatgcatacgtaaacaaataatgtatatagaaatattcctacacatgtgtatgtatatgtatatttagatgtcctttttaaaaatttttttgtatttaaagagatagggttttcctctgtcactcaggttgtagtacagtggtgtgatcatagctcactgtaagccttgaactcctgggcccaagcagtccttttgcctcagcttcccaagtaactatttctacaggtggatgccaccatgcctagctaatgaaaaaaaaatttttttttataaaatacagttgaagtcttgctatgttgcacaggctggtctgaaacttctgttcttaagcagtcttcctgtgttggcctcccaaagtgctgggattacaggcataagccacagcatctggccagatatatgtttttaaagacaaaaatgagattatgtcgtataagtaacttgccatttttggagtttagatttattgagatgtaatttagtaaaattcaccctttttagtgtatacgtccataagtcttgacaagcagagacattcaattctcactataagcatgatacagaacagttctgtcaccctcaaaaatctccttgttcctcttctgtagtcatctccttcctctttcaaccatttatttcttttctgttccttttacaaaatggtatcatacagtttgtagtttgaagtattgtttctttcctgtagcatgtgttttcctttatgatttttggttttgagatcatgcttcaagaatcttttatcaaattgatgagaatattcatgtatatatttttaaagaattctgtttttttcaattttaaaaattttaagtgtttgttcagtctcgtgcttattttagtgtaagttgtgaggtaggaaatccaattaaaaatcagatagttcagctgtatttattaagattgatttactaatataatgttcttactaaatattgatttcctcacaggtaacacaagtggcaagacagccgggaacccctaccccatccccttattcagcacatgaaataaacaaggggcatccaaatcttgcggcaacgcccccgggacatgcatcgtcccctggactctctcaagtaagataaaccttttttaaaaaaataagaaatgtccctgtaaaggcatcatttttgtttttctaaagagactcctaagcagtaacataaaacattacttgtatagtaatttcaagtttgtctttggcatcttttcagacttaaccgttcataaagatggctactaacaaatttcacacatttcattttgaagtcattaaaaattaactgttggtgatatttagttttcattttcattgtttaagaagttagagttttattctaaagtttactggaaaacccccccacaaagcactgatttgcttttcgatgcttaatctgctaccgtctcgcacccctttcgggtgaagcattaatggttattttctacttatgtgaaaacttggtgtcttcccctcttgagtagcatcagtgggattttttgtttgttggtttggttgttttgtaagtcgattattgtaatttgataggcttaagtttttgttgaactgttagaagaattgtgaactccttagtgtatttctacttaatagtaacaacagacgttcagacactgtttaaggaggatgttcctatgtgttccttgcacttaagctgtttgccaagatatattgtttagcttgcaccgacctactgttgcaagcttgtttggatttccttgtggttaaaagttggctagagttataaagtcccttacagaatgtggactgagtcaagccaataacgttgatctaactgtgtgagattatcagtatttacatgtaacagctactcttttgataatgaaaatcatttttataacattatttgtgattttagcctccatattttaggccttttagagattgaataataggagagatcaggaattactaaaaataatgctaaaggtggtgattataagttaagggctgattttattttttattcttcattattttttagggacaatttttattccttattatttttttaaagacagggtcttgctccgtggccaaggctggggtacagtggcatgatcatagctcactgtaacctctaactcctgggctcaagtgatcttcttgcctcagcttcccagttagctgagaccacaggctcatgccaccatgcccggctaatttttttcttttggttaaattttttgtagagatggggtcttgctatgttgctcagattggccttgatctcctggccatgtgctgattaattatattttagactatagaatgtttggaaaaggaatgtacagtttgccaaaccatgactgaaatagccctattaatgaatataagtttgtcaagaacttagtgctatacctaaacttagtctaaatcattcctatataatttggagttttaaacattgaaaacaaaacaaaatgagctcctgattgtttaaatgaggttcctgtgttgggtttcttagactgaacacaacctctcaacttactattaaggtgtattaatctgagtctaatcaggagagaaaaactatgcactctcaagaatataagatataaagagcaaacgcttaccttagggctgagtagaggctcagatagggagcctttctctgtagggttgagccaaaggctgtggtagaagagccactgtggtgctgttcagaacttgctgaaactctttgttctggaacttgctggaaatgtgccctatgaagtattggggaaagctttcttctccagcaccaatctcttatagccaagagctgatgcagggcacaatggctaaaaggctccttactgcatatctgtttcccacagacaattcaaaacattagatccactggatcagaagtcccaagtggtagagcagcttgcactgcccatcccaaatttgctgtataaccttcgtatattgtgttccctactcaaaattggaaacttcctaggtgactctgtagtcggttaaggtggcacattcagatgtagtatatatgttgcctctacatccaaaaaaggcctaccaaacctacgtcttattttttgtggtagttttaggtgagagactgctacccctaccctgggctaagatcttgaccttgttggagagggcacggtgtggctttctgaatgggagtggtgccatttcagtggaagttactgaaaatccaccctcagaacttgtgagaattctgccctctagggtgccgagggaaagctgttcgcagggaggtttcttagaaaagccactgtgctgcgtgtcttcctgagggaataccaggggtagctcttggctgctgggtactgttgcttgctgtgcactgaagcagaaatcttgctctgatgaagctatgtccatgaggggagctagtcactagagaagccatcttttggagaagctatctgggctgcaggagcaaccaggaaccaggaaccaggaaccagggagcaaaaccctttccttctacatatctctagagccttctactgacaaaacttaatgttgtgtcagctgaaatgttaaaatatttatagagctcagatccattttcttattacaggcaaacagtgaattttgatatgaaagacaagcagttgataactggcatgtaagggaaatagcttagttttccatttgaaattcttactgtttcaagttgtgatttgacccaagcagttggcccaaaggacttaagttttctgaaagataggctgctcgcaaatgcatagtttgcatttaagaaaagatggtctcctagcatctcacttgttaaatcctcaagtgctgttctatatgccattttaccaggtgcctttagaaaccagagtacatgaataccagggagaatggccaccaaatattgtgttgcattcttttgtggtctgttttgccaccattttgcctaatctaatgaatgaacccagtaaatcacacctggttcaatgcccttttttcccctccatcctttcagacagagggaagcctctatggattcatctgtctcctagcaatatgttaacacttgttgatatggtgaggaagtttttctaaactagcatacctggaaaaatgaagagttccatgggaaactcaagttttttttaggtttcacagttgaaacagtttgtaggggcagatgcaaagcttcccttctgcccactctgagggtttgctgaaatgctgatgatagattaataggagaaaaaggcatacagatttatcaatgtgcgtggacacatgagagtcctacacatatgaaacacgaagaagggagagaaggttgagggcttgagtaccctcttcatagggaagagggaagcagggtggggaatgggctatcgggagttttagaggggaagtaaatggtttttaggtgaaatgaatgagtccaaattacaatagtcttagacaaagttcctctgagctcctgggaggtggcgggaaggtgaggaatgagacttcagtgtgaacaaaggttgtcttattatgaaggttaaatctcctaagagttacccccaaaagtaaaatgaaaagtctgtcttgatgtggtgatggctttagtctcttctgttttccatgattaatcttttgtgattatttgatgagcttccatgggagggtggtcttaagacaattgtgtttcttttggaaagacattttcttagtcatatctctgtgccccaccaagttcatggatggtaatggaaagaagagcgttcaaaatagaggggaagggattataggcttgaagtcaaaccataggttctagggctggctttgttactttctggttatatgatattggataaattatttaatatctctggaacttcgtttcttcatctgtcatatagggggaaattagaattctactgccctgtaagagcgttgttatgatggttgtgtaaattcctgcctcagaacaggatttcctaaatttagtaagtgcatttattatttgtattcctgccagacttggttctcctcaagatttatatatatgtatgtgtgtgtgtgcatgtatccttgcctgctaattcttttatttggctacctgtcgagatttagtgtgaaacttagaagctatctccaagagtttgaaatgtcttccatgtcttttctgatgttcggataaaagtaggatattaggcttggttattttctgttggcggtaatttgttttattcttctatacaaaacagattcagtcaactgaggataagatcaaagaaactattttttagctacatgtcctttttgatgtgacagtctccccttcttctgtgaattaaatctttttgtccaaagtaactacctatgtctgtgactcaatgtttgaccctcaatctactaaggtctaagtgaaagaagctaagctgaagaaaagtgaacttcataactttgaaacgtgaaagagggaaaatgaagaatattgtttccaatgtcctctgcaatctcattacctgcttctttgttaagacaggattttacacatccacaggtgcttcaccacacctgtgtatgtgccaagttttaaggcgtaatgtgcatttcccttttttacatgagctgtagttctttctagcttcgtcctctctggagattttgtttaattagtcaaagactttagactatgacatttcagacaatggtaaattggtgagacagagtctttataggcatagattcttttcagtttccctgaaatggcaacacttttgaacaatcttgaaacccagcatgtctgttctctgggaagagtaaatagtttggaatttaaaagtaccttttggtggcagattgcaaagtaaatctccctggggaagtgcactctagggagtcaggagaagagactctctaatttagagttccaaccctcctaccactgttttataatttaacctatggaagttcctattaatgcccagttttcttctttgtgaatgagcagcttttgttagatgagatcagaattttctttaagacttccgtgggttttggacactaacttgaaagtagccagttgttgttatggaaaattataaaactattttagatttaaaattacccaaactttgccttgtttcattctgtttttttttttaagagaagtttgaattatttaaaattacttctcaagataagtaaaaacaaaagagactcctacttattgcttaattggtgatgcacatttgctttaacttagttaattttcacgaagtagcaattacaaaacagaccaaactggcgctgattaactaggatcaaaatctaggtcttttttctcttggcatcattgtctagacttccaggcttttggagctatattcacagtaattaagtgagaagacatgctcaaaatgatgccaaagaagtgaggtaataggtgttatctgcctgctgtttctggatttcatttggctctctgtttttttctgggagaggaactccttctatagcatataatatatagtagctgagatggtgatggtatatgatccactggttagatactttattgtctctggaaatactaagcagagttcttcactgaggagtattgcttgatcgtgatgcttattgttacaccacaattttcatcattagtaaaggatgagtttcaaatgatgaatggtcccaacacccatttttgctttatccagcttccgggaatcttgttttatttactaaggagaatttctctgtgttgtctcataattgttcattgactgactgctccagcctttgtaagctgtttttttatttattttttatttttagagacaggacctcactctgtcacccaggctggagtgcagcagtgtgatcatagctcactgcagccttgaccccctggactcaagcagttcttcaggtagctgggactgtatgcgagctccatgatggctgactaattttttaattttttgcagagatgggacttgctttgttgccaaggcaggttttgtttctaaatcctggcctcatacagtcctccagcctcagcctcacaaagtagtgggattataggcttgagccatggtgcccttctgagaccctgtctctacaaaagatgtaaaaaatactagctaggtgtgatggcacacacttgtagtcccagctacttgggaggctgaggtgagaggatcgcttgagactgggatgttaaggctgcagtgagctgggatcacaccattacactccagcctgggtggcagagtgagaccctgtctcaaaggaaaaaaaaaaacaaaaaaaaaaacgaatgaagtttaatagtgatttttccttactacatatgcttttttttctttttgttaccttttgtgaagaatataaattctgagtttgatgcacacttgttaaccatgataaagtagaggaagctgtgaaaatttgctttaagaaaacatcacatttcattgttgaaatagatgagtatggaatttaatttaaaaaaagcaaaatgtatagtttttacactccccatggcccccactttgaaacacatcatgtccatctaaggcagtatttgagcttaccaggattctttagcatatcacaaatataaatatgaatattttataggcctttgtaacttttaatgacatttgcaaagtcatgttatttgtaaagtgtttaatgacaatatttgttgacacttttaaaaaaaagtagatttttaagaacttacacatattatcaacttaaaaaaaccaaatggaggatttgtcaccaaggggaccaactcagtgcagtcagtactgcaggtgtccaaacccacaccaagtccccatgtaccatgaatgcagcttccaaagaatcatggtaggcttttctaattgttgagatttattttaatgtgatacttgattggaagagtgttcagctcttttggtcattttttgtttttatttaaaaaattagttgcaaccatatttataaagcaaccttgaccaaatgtttttctaataggtgtttcatctctctctctctctctttctttccatccttcctttttttttttttgcgccaaggtttcactctgtcacccaaactggagtgcagtgtgttttctgctcactgcagtctccacctcccaggctcaagctatcctcctgccttagcctcctgagagtagctgggactaactgactttttgtatttctttgtagaaactgggtttcctcatgttgctcaggctggtctcgaactcctgagttcaagcaacccacctgccttggcctcacagagtgctaggattacaggtgtgagccaccgtgcctggcctaggtgtttaatcttttatgcagtcctgtaacttaccttgaaatgtgcctaaagcagcttttatatgtttgattatacttctctttgtattgcctgtagccgaaaagaattccatttattttcttttgacatttctgtggttagtttttaaatgttgctgcaagagtgatggttaagtacaattatttttcagacttctcaccctaagttttacattctgtttggcaaattcacatggctggaacccacattttatctaagtattaattcagcactattacagcaagctaaagaattttgtaagaaccaaactgattgtgattttgtaagcatttctttacttctgttttatgtaggctcagtcttttgttgatgatgttcattttcacttaaatcctgtcaaaggcaaaaggtttaggattttgtcttttacatttgaacagctgtttcttttggatgcatcctgggagactcttgtttatttctctggctacctctcatctgttttaagaagtcatgaaaaactctgtcagcgtttttcttgccagtttacctcttgggaatatcacacttcatttatttcccacagatttgggggaaaaactcactttagtgccactaatttattttttatctggttgtgacattcagatttttagatttttatggttctgaaaattgctaattcagttcagctgcagagattagcatgtgtcagtaaattttaggatgagaaacagaacaggtaagttttaagaataatgaagaaattgtgcagtttgactcttcaatttaaagtgcttgtgatagttcctgcaaaaatgtatatgtgattcagagcgtgttgtgggggaagtgagcagacagaactctgagggaaagctcagcagagaggttaagtaccatagtagacatgtataatattgtcttgagtttagtcaggcaaatgggtatatatgtcttttcagatttattgtagtggacgggagcatgctgattgctgggagagaaatgagaagacaagcttgattcaggactgtttttataagggatcaaatgaaaaaatttacttaaaagtcacaaactataaaatgtagtgtacaaaggctagctatctttatagaactaagaactgtgaatttcagtgactcagcaatcaataaaaagtcaataacacacacatcttgtagatgatggtcattttaaattttctcaatgaatagtaaagagagattaacttagttatatttaaagcaaatagaatcaattaagtataaagaatgaatattataaattgatatatagaacgactattagaaaataaaaatgttgggctgggtgaggtggctcttgcttataatcccagcactttgggaggctgaggtgggcagttcacttgcgctcaggagtttcagaccagtctgggcaatgtggggaaaccccatctctacaaaaattagccgggtatggcggcgtgggcctctcgtctcacctgattgggaggctaaagtgggagcatcccctgagtccagaaggtcaaggctgcagtgagccatgcttgtgccactgcactccagctttggcggcagagtgagaccctgtctccaaaaaaaaaaaaaagaaaagaaaagaaatttgttataatttactcactaaaccaacaaactttttttctcagtgcatacatttatttacgtttttttccctctaatgtctagtcatgcttataatgtaacacgaagggctaagtctgatttccaagcttttcatcagttgatggacccttttctctgtgaagaatgatgaactctcaagctatctaaattctgtctcccttgtgtgtgtgttctctgtaaagtagtttgtttcatagaaaacccctaagtaggtgacatattgcagaaaccatgttgccaacattttgttatacttttcatgtaaaacatatttccatttctcttcactgccagtgtttctccagtttcaagtactacactatattattcaaaattctgtttattactccacatcttactactcttaatcaccatgaaaattgcccatcttcttttatagttcagtttcaaattttcacatgcctgtttagtgcagttgtcatagtcttagtaagaaataaattacactaaactatttcaaatggagaggatttttaatacatgaatttgttatactggctgaatgattaataagggggatgctgaggctgggcattgtggttcacacctgtaatcctagcactttgggagcctgaggtggaaggatagcttgagcccaagagttcgagatgagcctgggcaacatagtgagacttggtctctacaaaaaataaaaataaaaaggaggatgcggaggtaatctagagattaataactgcagaaagcagctgacatccctgagagaaagtcaggaaaggggaaatacaaagtaaatgtgataagacatctggactgtgaaacatattcataactgttaaaattaaaatgtagtcgaattaaatttaaaggagtttaattgagcagtgaatgactggtgcaggcatcccccagaatcacggcaaattcatagagactctaggggtaccttctgatcagaacaaatttatagaccaaaaaaagggaaagtgttaaaaaaaaaaatcagaagtgaggtacagaaacacctgaattggttacagggtgacgtttgccttgtttgaacactcagcagtctatgattggttgaagtatggctgctgggattggccaagactcagctgtttttacagctgcatactctttaggttttcagtcttgtctgccttttaagctgagttagggttcatccacagggactcagatttaaaagtacggagtccttctcagaccatatttagttcgctttaacagaactgtaataacaacacagttaaattatctcaattcattggtcaaatctcaactcaaattggtcaaaaaccaaaatctaggaatatgcatttaaacttgacacagaaagattaaaaacattcctctagactgccttcccaccccttcagataccagccatacgtcccggcctctggaacttttgactgactggcttcaatttggggatctcatgatcccctctttgggtttgataaatttgctggagcagcttacagatctcaggaaaacatgtttacttgtttattataaaggatatcacaaaggatacagttgaagagatgcctatggtaaggtatgggggaaggggcacagagcttctctgcccttccttggtgcaccaccctccagcaacttccatgtgtttggttacgtagaagctcacttaaccgtgtcctaggttttttggagacttcattatgtgcatgattggttaaactgttggccactggtgatcaacttgacctttagcccctctccttcccctgaggttgggggtccgactgaaagtcccaaccctctaatcatgcccttgtgatgatcaactctagctgtcagtcaacattagcatacaaaaagacagacgttggcgattctaaggtttttagaagttgtgtgacaggaatcaggatgaagaccaaatatgtatttcataatatcactgtggtggtgtcagaaactttacatgctgaggtgtgagcagagagagtgtatctataaaatgtttgcatgtcactaacgattattgatttagaacatcttttaaagtgcttattggccatttgtctatttttggagaaatgtctattcaaagccctttgcccattttttaattgggttgcttctttcgttgttgttgagttgtaggagttctttatatgttctggatatcaattccttatcagttatgtgatttatatatattttatcctatcctgtcaggtgccttttcactttgttgatagtgttctttacagaaagtttttaatttttggatttttttgagacaggtctcattctgtacaccagtctggagttcagggtgttggaaataactcactgtagcttccgtctctgggatacaagggatccccccagcttatcctcccaagtagctgggacgacaggcatgtgccaccatgcctcgctcacaagtttttaattttgataaagtctaatttatcttttgttgtctgtgcttttggtgtcatatctaagaaaacattgccaaatttgatgttctgaaagtttccccctatgttcctttgttggaattgtatacttttagctcttacatttagatctatgattcattttaaaaattttgtttttctgtgttctctcacagaatggaactatgattcatttgatttaatttttatgtatggtttaagataaaggcctggcttcgtttttttggcatgtggctatccagtttttctagcaccattggttgaaaagactgtcctttacccgttgaatagtcttggcacctttgtcaaaaatcatttgaccacgtatgtgaaggtttatttccgggctcttttcttttcattgctctgtatgtctgtctgtatgccagtaccatactgacttgattcttgtagctttgtagtaagttttgaaatccaggtttgagacgtttaggtttgtcctcctttttcgagattgttttggctattgggggacccttgagattccatatgaattttagaatgggcttttctattttcccaaaatttgtttttgggatttttataggattctgtgtatttaaaaaaaaatatgtttcataatggacacaacattctttttctaagtaggtgaagaaagcatcattgcttgagagtggaattaagatgtagtattcaccttaataaagaacttatacataacttttatagacactcccaagaactgggaatgttctagttaatgattcccttcgtaggtacttaaaaatctaatttgaagtcctagttctaagagaaacagagagagagaagaaagaaagaaattagtggagtaggaggtggtctgaattaggggtatatcaggacctagagtgaagattatgtctagtggtctcgtgtgacaaatgaatgagaactctggctagggatgttttagctgagatgtagaagaagaaactgacaggaaaccagagactatgtaaaggtgggagaaatgaggggaagaaattagtagagataatcgtggtggctatcagtagtaggtccagagagggtcctaaatagcagccattgaagtaggaagtggagagccagcattgcagacattgtagaatacttttgttgggaattcagtgaaccaacagcatctctttatcagtacactggtgcttttagcccacagtcttgggggaactggtcctgggattggagagaaaactgagttgtcatgctgtataagtaaaagctaagctttgaatagtatagttgcttttgagagaacacaagtagcctgtgatcaagctatcctattatgtgagtctattattgtcttctgaggggcagaaagccatagcatttcaatgttgaactaattataaagagtacaaaaatggtgatgatttcagtagtgtttccctgctccatatagtatcactgctcagaagtgagaaagagtttgatcagtggttttcatttctgccttcccacttagaatcacctgatgcctgggtccccttctccagagattctcatttaattgcttgggatgagcctaggtaatgctaatgtgcacccagcattgagacaaagctgtggaacagtgccttttccctcctctaatcccacagccgattaggaacagtgccttttgatacatattgcccaaatgatactttataggctttgtttgctgaggatggttttcactgaaaggagcaagatgcccccattttcagatcttatacaagcaaagtgaattgggctagtcttaatttagggaaagtagctctggtgattgagaagacatttctgttcagtagctaaaacagactgttacagcttttttacagataatatgctttgcatcgtggtctgtactcagaaggtttttacggtattgattttatatgccaatttattttggtgatagaaccaaattataccctgccaggtactatgtaattgactcttctgattcacccagaataagagtgggtgttttttgcttccatacaatcagatacgcctagatttaaagttatactatagtgttttcaaactgttaaaagcagccaaactgcttccccccatatgacgagcagtgcctgatccatagtaagcccctaaatagttgaatgaaaactagctgtaaatgaaattttccagaagtgtcactttttggctgtttgcagtgtggatgctttatttggcgcaatagcttttttttttttttttcctttttctgactggtactgttaattttgtacagttcagtaaaagtttaccagtacaagcttaacttaaaaagagccaaatactctaagccacccttagagaccttattctgtgagggtctgggaatcttaatattccagctgttctgtcattgtgaatcaaataattaagacttaattgctaagctggaaaagtcttttttaggatgccatgacagagatttaggtcttttaaaccagttcagtactatactgaatagagaatttcttactttttctgagtaggtgatctcattgtttagtatgaatatttctagaatgtaactcataaataagcttttattttattatttttttagaggtggagtctcactctgtctctaggttggagtgcagtggcacgatcttggctcattgcaacctctacctcctgggctcaaaccatcctcccacctcagcctctcaagtagctaagactataggtgcatgccaccacacctggctaatttttgtatttttttgtagagacggggttttgccatgttgcccaggctggccttgacctcctgagctcaagcaatccacctgcctcagcctcccaaagtgttgggattacaggtgtgagccactgcgcccagcccacaaataagcatttatatagagacatggtatggtggctaggtataaagaaataccatctctgtgtaactgattttaaatattaaggtgtttaaagaaaggtaatgagagatgatgattcatgctcttttttttgtactaacattacgggatctttggggtgtcacttttctggccagaaacctctgtggcctgtggcacctttgcctgagttcttgtcctgcgtccaggaagattgaggtatgcagacaagtgtagagtgtacaagatgaagaggagctttactgagtgtcagagcagctcagaggagacctgcagtgggcagttcctctctgtaggcaggtcatcttgttgagtgttcgactctcggcagagaggaggccctagagtgggtggctcctctcgtcagccaggttgtcccattgtctctgcagctctcagcagagaggaggcctgcagtgggtggctcctctctgcctttggtcgtcctgatgtctgttgctctcagccagagaggaggccctggagcaggtggcttctctctgtaggcaggtcattccagtgtttgcagctctcagcagagaggaggccctagagagggtagctcctctctacagctggtcatcctgatgtctctccttcctctgccctgctctggttgagcctgaggcttttatgggccttacaggggaggtggtgcatgccagttggtccgtgggcagcccagaaaaggcaccacaagtccccactctggtccatgggatgggtagcccacccctagccttcagaacctccctggcaaaaggtggggcctcactgaggactcgccccttctggcacaggagcccatttgcctcccaccactgcctatggcccccaggttacttgtgccaagggatgcccacaggctatcgctgaactgcccccctgccctatcttggccactctcctgtggtctttggcacccaaagtttggaggggccaagctggaagggacccagcgggtcagtgctgccctgagcctatgcatacctggctgggctgcaacagtgcccgggcttggccccaaccccaattggagaccagagcagatgctgggagtggggagaggccaggcagcaggagcagacacccctgagcctgtggtgacaggggctctcccaggcccctgagagcattgagaggcctgggcccacagccatgacctgagtggctggagctgtgcctggggagctcctgccctgccaactcaggaggggtgggactcctgcctgtccccggctgcagagtacacagccttagctgtgctccttctctgtgtcttcccatagccacggcaggtaaggtgcaggtggcatggtggccctggccagccctgcacaaatgaacctttggctcccaggacacggccagaagtgaggttgaggctgcagtggcctcaggcctgggagtgggtcctacccagctgtgccagggtgggggtggcacagttggcttccttggggacatgggcacaggggtcctactgctgctcctacagccactcctgctgccctgtcccgcctccttgccacctggggtggggctccaggccctcaccgggcctggactggcatccagggcaggggtgatgtcgttgcagggtccccctgcagccccagggctcccccttgcctggcttacgaccctgccagggtggcgcctctgggagcagattctgggcccaggcccagccaccaggagtgccaggctcagcagacaccctgacatggggcagatcctggggacacgatctccggtggtgccaatctgagcctactgccgaagtacgggaacctggtaccatcccagggccacaggccccatgtaccattcgccttggtgtctatacctgagcacctgtggcctgcggccgcaccccacctctgccagtgccatgtcagcagccactttgtatggtccatcactgcaatcactaagatagtatttcagtttacagagtattatgtgaaattggtttacttggcaaaattgtctcatactataattctgttttatagtgataaatatttttagagtttggttgatagaatggcatcacaaatacagctgttgaatgggtgatgaataatattaaagtgtacttcaatttgtgtagagtactgctcattaaatatctgtttttgaagtaacagagtaagaataattggatggtcgtaatgtagaataaaacacatactgtgacttaaatgaatgttttgagttgcttaaaacattcattaaaaaatttccaaaagttacaattaagtaagagcaatatttgtggtagataacatttaaaatacagccttttttattttcaagtactaatgtccctggtgttgaaaagagatcccattcagaaataaataatctctctactggagctcttcttgaagagtcctcaagtacagcccaacaattgaactgtgataaattcccagaaaaaaattttctttgttactttcagacagtctccctctgtcatccaggctggagtgtgttgtcataatcatagttcttgaactcctgggctcaagggatcctcccatctcagccaccctcacctcagcctcccaagtagttagtactacaggcacataccagcacacccagctaatttgtaaaatttttttttatagaggcagggtctcactgtattgcccaggctggtcttgaactcaccttagtctatcctccctccttggcctcctgaagcgctgggattacaggcataagctatcacgcgtggcctttttattcttattgatctaactagaaagattgatcatacagtattcccgatgttctcttcatcaccaccttcaaactataaactgtggaaaagaattttcagtttgctatagtataaaggctgcattacataaagtgaagtatgttttcaaaacagagacctggctgtgaatcacagttctatcacttactaattgtgagatctttcataaattgaaccttattccacgtggaagtcctgccatttgttcaatagaaataacagtgcctgcatcataggatgctaaataaatgttccttgcctgtcttttgttgcagtagctttggcgtatttaacttttttttttttaagttcagaattctagagaatgaattctttatctgctctgctgttaggtttcaatatcatgtttctggaactttttcttaactctttcatatcagtttatgatactttaatcatcattactgaaaaccagatgttactaataggtatttatatcatgaaatattatttcctaatattgttaaaagatttcattagtttgactcttaccgtatttattatgtgtgatttatttttcctgcattgttgtttaaaaaataaaaacaacaaaaacttacacatcaggtaaaactgatatatagagtagtttagaaatcccaggataaccactcagaaagtcatggtgattaccttgatgtcatctagaaacatagtgaggttactgtgtaaagttttccagaaatcattcagcagtgttagctgttaagcaaatattagagcacatgaaaaggaaaaattctgacttagtaggcatatctgttactagtttctttgagaagcagtccgtcattgtattatgatggatttgggaaagagttcaagtgctaaaatagttcataaggaaaagaattcatttctggtttatgtatgccagcttttattttgtgaggtggattatggcctcttgatcgttattctgtaccatattttcactcccttttttcactccgttttttttaaaagctatttttgttcataaactctgtagaattgtaggcagaagaaattacacatgacatctgatccattggtattgctttttgttagtaactcttcataaatagaattcaagatgaaaacatttgaagaacataacctgaaataatggtttggcctttctgaaaagtctggttttgcccagtcttattgtaaatcagtataagactttttttttttaatggctgaaacattttttcctaactaaatcaaataaaacaataatttttcatcttcaaggtagatatgaggaagaagatgaagagaggatgcactatctattaatatttggctagattaattgtatttgtttacattgaagtttgattcacatttatcccaagtcatccattagaaccatgctgaggattagatagactttgaattgtaatgtacattttttaatttattagatgagcagtgtcatgaggaatgaatagttctgccaaagataactaataattactatttttcacctttcatgcctatccttttgctggattttatgaggataaaaaattataagcaatcggcttgtctgcagggaaacatctgtgctataatttccagcgttaatggatatagtagaaaagttggaaatgatttaaaaagatgaagtccatggaggtttattttggtaaataggatttatgtgttttgatttctctttaaacctgtttttaaagctattttattgaatacgttttcttcctctccacctgaagcaacaaatagcaagattcttttagaggtccattcttaatacaactatttggatgcctggtatttgtagagtacatactgtatgttagatgtaaattgatttatttgggaaagaccaccacacaaagttattattttccttatgaactgccacttgtatatttaagtcatttgtttctctgagaagaatattctaaagtttatgtgactttgtattctaaatttcagaagaattaggagcttagtcctagaatcaagaaattctgcttctgctatttattagttatctggatatactttttattttataggggtgagattgcttgtagaatctctctctgctaacatcctgttactggactttttggcaagtcctttttgttgtcatattttttccttacacactttctttgaactcttcctccatctccttactctgtggaaatttatgtaacactactttccttagaaatccttccacttcaacattgttagtgttcttatattctttatatcttggaaggcaactcagcaacctcctggcccttcaccgctttctgtaggttgtttgcctgcaacccttgtgccgaaaatgcataaacagctctctctccctcttttttttttttttttttgccatcattcctcatttttctggacccattttctcattgtttgagaattttagtgtctggctcataatttacttttctgttttgctttctgccatccacaaagatgacttgtgacattcattgttgtgctgtccaaccattgcctgtgggctcctggatctaccctgtttgttgttgttgttgttgttgtgttttttttttgagacagtctcactctgctgcacaggctggagtgcagtggtgtgatcttggctcactgcggcccacacctcctgggttcaagtgattctcctgcctcagccacccaaatagctgggattacaggcatgtgccacgctgcctggctaatttttgtatttttagtaggggtggagtttcaccatgttggccaggctgatcttgaactcctgacctcaagtgatccacccacttcagcctcccaaattgctgggattacaggcatgagccaccacacccggctgatccttttttcttcccattctttgcctcccaatagcaactgtatatagacacatattcagcaatctatatggacacagtctagatctgcactgtccaatgtggtcgctattagagccactgtggcttttgagcacttgaaacatagtttctgcaaattgagatgttttgtaagtgtaaaacacaaaattaatttcaccagttttaagtttttctaatctggtgacctagaaaattttaaattacttacttgtgtggtttgtattgtattttttatatttttgttacgagcactggcctggacctggtctctactgatgtattagtccattttcagggtgctggtaaagatatacttgacactgggcaatttacaaaagaaagaggtttgttggacttgggctccacatggctggggaggcctcacaatcatggcagaaggcaagggagagcaagtcacatcttacatggatggcagcaggcaaaaagggagcttgtgtagggcaactcccatttctaaaaccatcagatcacgtgacacccattcactatcaagagaacagcacaggaaaagacctgcctccataattcagtcatctctcactgggttccccccataacacatgggaattatgggagcttacaagatgagatttgggtggagacacagagccaaaccatatcagctgagaactgctctgcctttgaattcttgaagtctaaaatttctccaaccagcccagtggctcatacctgtaattccagcactttgggaggttgaggcaggatgatcacttgaagcgaggagtttgaggccatcctgggcctcaaacatctggtccagcaaagcaagaccctgtctccacaaaaaatttttaaaaattagttgggcatggtgttttacacctgtagtctcagctacttgggaggctgaggtaggaggatcccctgagcccaggagttcatggctcactgcagcatgattgtgccactgtgctccagcctggcaacaaagtgagaccctgtctcaagaataaaaaataaaataataaataaataacatttttctgaccatagtctttgttcctttttcctatcccatgccagtcctgttatacctatttcacagcctacaaccttttaattctttaatccatttcttttctcaagatggcagcccctttctgccttcactttctcttatttacccttgatcctatcactaactactataactttatttttataaaaccactagttctctttgttttaaaaaaatcaaactaatggtttattttgtagtgatgaggtcttgctatgttgtgcaggcttgtctcaaactcctggcttcaagtgatccttctgccttggcctcccaaagtgttaggattacaggcgtgagccactgcacctggcccactagttcccttcccccccccgactcaatttctctttcttcccagttctcgtccctgaatctaactcagcaggtcttttcctctgttcttgctcccaggatggatggctctgctttggaaattccattacctgtgttcgtggagtctaattaaaactttatgattggggccaggcatggtggctcatgcctgtaattccagcactttgggaggctgaggcaggcggatcacgtgaggccaggagttcaagaccagcctagccaaagtggtgaaaccttgtctctactaaaaaatataaaacattagctgggtgtggttgtgtgcacctgtggtttcagctactcgggaggctgaggcatgagaatcgcttggacctagggggtggaggttgcagtgagccgggatcacgccactgtaccccagagcgagactttgtttgggccaggcgcattggctcaagccagtaattccagcactttgggaagctgaggctggagattcacttgcggcatccaggagtgagaggttacgatgagctgtgatcatgaactcccgcttgggcaacagcaagactgtatctcaaacaaaaaattaatgatttattaatacagctggtctaaactctatttaggtataatatagctacaacttagctgcttgataatctttttagtaatcactaattgactttcagtcatatcctgaactgtgcttacttcagtactaggttggtcaccaacagctcgacaggccatacactgtatatagcttgtgaagttatgtatcatgagtagctctgcttcaccttgtctaattctgctgcttactgtttgttgaaacacctgtgttttacaatttattatgacatgtttaagcttataaaagtatattgtaacgtgtttggtttgaaaggataatcataacacaaccaaccaccactcaccttaagtcgattatcaatatctttgaagccactctgtattcctcctttatctcagctgcctctttctccctagtggtaacaattatcctgagttttgtataagtagatatttgttttataatttcactggtgtctgcattttgaggtttacattttgaattagccatcatgtgtgaccttgggcaacttactttattatctctgaacctttctcttttttttcccaatttaaaaaattgtgttaaaatgcaaatagcacaaagtttaaaatcttaaccccatttttaagtgtacattttaagtatacattgataatatgcagtgatcacacgatccatctttataactcttttctttcatcttgtaaaactgaaagtctatacccattaaacaataacttccctttgacccctccctttgcaccctggcaacagccattctcctgtctgtctgtggctttggctattctttaactacatcatataactgttatcatacagtagttgtttgtgcctggcttatttcacttagcatattgtcctcaagttccatccattttgtaggatatgtcagaattccctttctttttaaggctaatgtttcactttatctatggtaccatattgtgcttatctattcatttgctgatgcatacttggttggctttcatgttttaccagttatgaataatagtgatatgaatgtggatgtacaaagaactcccttaagacctcgttttcatttatttagagtggatacttggaagtggaattgcagaactgtatggttattcctattttttgtgaaaatgccatactgttttccacaatggctgtacctattttacattcctaccaacagtgtgcaagagttccactttctccacatcttttacaacacttttccttttttttgagatggagtcttgctgtgttgcccaagttgaagtgcagtggggcgatctcggctcactgcaacctctgcctcctgagttcaagcgattctcctgcctcagcctcccaagtatctgggactacaggcccgtgccaccatgcccggctaattttttgtatttttagtagacacaggctttcactgggttagccaggatggtctcgaactcctgaccttgtgatctgcatgccttggcctaccaaagtgctgggattacaggcacgagccactgtgctgagcatggtggcacgcacctgtagtctcagctacttgggaagctgaggcaggagaatcacttgaacccgggaggtggaggttgcagggagctgagatcttgccactgcactccagcctgggcgacagagcgagactctgtctcaaaaaaaaaaaaaaaaattgtatgtgtgtatgtacacatatatatactagccatcttggtgtgaggaggtgatatataccaatatagtattgatttgtatttccttaggattagcatattttcatgggcttgttggccatttgtgtatgtctttttaatagaaatgtctattcgtgtcctttgcccatttctgaatctgattgtttgcttttttgtgattgagttttaggagttctatatattcaggatattaactttttttttttttttttttgagacagtgtctccctctgtcacgcaggctggagtgcagtggtgcgatctcagctcactgcaacctccgcctcctgggtttaaatgattatcgtgcctcagccacctgagtatctgggattgccattcctggctcatttttgtatttttagtagagacagggttttgccatgatggtcaggttggtctcgaactcctggcctcaagtgatttccccaccttggcctcccaaagtgctgggattacaaacaggccatggtgcccagcccaggatattaactttttaacaggtgtacagtttacaaatattttctcttcttctgtaggttgcctcttgactctcttggtgtaatatctttcgatgcacaaaaattttaaattgttaatatgcccaagttgtctacttttttttttttttgcttctgcctttggtattgtatctaagaagtcattgccaaatccagtgtttcagagcgttttctctctgatttcttctcagatttttttacttttagctcttacattttggtcttaatctattttgacttaatttttgtatttggtgttaagtgagggtctaacttcattcttttgcatatgtatatctaatttctcccagaaccatttgttgaaaatgtcctttccccattgaatggttttggtacccttttcaaaaatcgtttgaacatatatttgtgggtttatttctgggccattttttcccatttctaattacttttggtttatttttacaccagtactgcacttttcatttttgcagatttgtaattttgaaatctggaattgtgaggcctccagcttttttcttttcagctattgttttggctatccagacttccttgagaatacatatgaatatcaggatggggagtttttctgtttttgtagaacacaccattgggattttgatagagattgcattgaatctgtaagtcactttgggttgtattggtatattaacaatattaaatcttccagttcatgaacaggggataattttttgttattgggtttttaggttatctcatccactctcatggcaaggactgttggttatgtttgctgattcttagttcattctgggttgactctgctctcttcatgcctaattactctgtagacttttgtacctagagatctctttgacattaaaactctccataatataaatgaattcatcacttttttattcaaagcagagaaaacaactattgcagaagccttgagagaaaaaaaagttgatatatttgagagaataaaataaggccagtatggctggacagtaatggtatgtgaagtgaagtcaatgatagcctgggacccaatcattttgggttctgtaagcattcttcaccatctaatcctcaaaccttggagaagcagctttcttccccttatatttaggtgctcagaaaatcctgctgtttctataatatatgaattaactcccaaatctgccttttttttttctgtcgagatccactgctgttatcaggcccttatcactatgtacctgggctgtcggaatagatccctgtttgatatcttgacaccagtatcttcactaagagttcatattgttgtaatggctctcttttttaaacaaattggatgatatttctgccctgttcaacatctcctaggattaccttcatggcgaagtccttacttgacccgtctttttagtctggccctaatctaatcctctgatgtcacctcctctcactctacctcatgcacttctattctctggcattactgacgtgtttatggttcagcagacgtgccctagtttttcaggtctttgtgcttctgtttaaaatattccttgttttgcctacacatgatctcctctgctttttatggctgactgcaagctcaccatctatcactgttgatctgccacctttggaggctccctggaactcttctcccaggaagaattaatcacattctgctctgtacttcttgatatattattcatactccttacaccactttctttttttttttttaaatttatttttttattgataattattgggtgtttctcacagagggggatttggcagggtcatgggacaatagtggagggaaggtcagcagataaacaagtgaacaaaggtctctggttttcctaggcagaggaccctgcggccttctgcagtgtttgtgtccctgattacttgagattagggattggtgatgactcttaacgagcatgctgccttcaggcatctgtttaacaaagcacatcttgcaccgcccttaatccatttaaccctgagtggacacagcacatgtttcagagagcacagggttgggggtaaggtcacagatcaacaggatcccaagggagaagaatttttcttagtgcagaacaaaatgaaaagtctcccatgtctacttctttctacacagacacggcaaccatccgatttctcaatcttttccccacctttcccccctttctattccacaaagccgccattgtcatcctggcccattctcaatgagctgttgggcacacctcccagacggggtggctggctgggcagggggctgacccccccacctccctcacggtcggggcggctggccgggcagaggggctcttcacttcccagtaggggcggccgggcagaggcgcccctcacctcccggacggggcggctggccgggcggggggctgaacccccacctccctcccggatggggcggctggccgggcggggggctgacccccccccacctccctcccggacggggtgactgccgggcggagacgctcctcacttcccagatggggtggctgctgggcggagaggctcctcacttctcagacggggcagctgccgggcggagggtctcctcacttctcagacggggtggttgccaggcagagggtctcctcacttctcagactgggcggccgggcagagacgctcctcacctcccagatggggtcgtggccgggcagaggcgctcctcacatcccagatggggcggcggggcagaggcgctccccacatctcagacgatgggcggccgggcagagacgctcctcacttcgtagatgtgatggcggccgggaagaggcgctcctcacttcctagatgggatggcggccgggcggagacgctcctcactttccagactgggcagccaggcagaggggctcctcacatcccagacgatgggcggccaggcagagacactcctcacttcccagacggggtggcggctgggcagaggctgcaatctcggcactttgggaggccaaggcagacggctgggaggtgtaggttgtagcgagccgagatcacgccactgcactccagcctgggcaccattgagcactgagtgaacaagactccgtctgccatcccggcacctcgggaggccgaggctggcggatcactcgcggttaggggctggagactggcccggccaacacagcgaaaccctgtctccaccaaaaccagtcaggcatggcggcgcgtgcctgcaatcgcaggcactcggcaggctgaggcaggagaatcaggcagggaggttgcagtgagccgagatggcagcagtacagtccagctttggctccgcatgagagggagacgtggaaagagagggagaccgtggggagagggagagggagggggagggggggagggggaggggagggggagggagagggagagcccttacaccactttctatgtcatttttactgttgttaggtaaattgtaaatccctgtgcataggaatcgtgtctttttcaacttgatttccatgacttagaattgctactgcaaacaaaaaagaaaaactcacaaacttgttagattgctacatctgaagtcaagtatagtttgagagtttttttcattctaatgtgagtaaaagtttttgcgtgcctaatgtttttaactgagggtactactaattagcatcctcgaaggaaagaaaactgaaagtgattttgctttaaagcttgttattcatagtaaaagaacatttaccatgtaattcagggaagctttagaaagaaaacctaggggatctgttggccatatcaaaaaagtacaagctacatggacagtgaggtgatactgtaatacttccacctgtaggtcaactggagagacttggttttttccaaatagacctagcttaattgtgatgacgcatgccaacctaattaacctcctaatgttacttgtctttgtttttgtattgtcaggaacttggtgtgtgggttgggaatattagaacataatagaactatgtgatgtctaaattgagctttaacacaaactggttggtgttattgagggaaagtataacttattagtgggaatgggaaaagaagcctgatgttgtggtgaggtagaaatttccactgtgttactgtgaacaggaagtaaagggctaatggtcggtgactcagctgttttctgaacctgtctcatatgattcagtgtgcatgatgtctgtttattctcgacagagtaagtactacgggagtcacattacacaggcagacataatgtttatttaaccaactcagtgatgacctaaaaataacttgtggggtttttgtactacatttagcataatcagatagaaaaatcataatggacacccatcattgagtgctttcccttataaataactggatatatagtcagccagtactatttcatttcttacattgttaaggtgcaatctttggtatttaaatgaaaggtagcaaaagaagatagcctttaaattatccataaaataattctgtaccattttagattatactttggacagatatgcattttcggtgcttagtgccatcgttgaggtatttttgcaccaaaattttcatataggaacctttttgtgaggctatagcaaatgttgttttgaaatagaaatttacgtatttgctggattttatgttaatattaaattatagtagcaatagttttactttgattttcttgatttattcatcttgtactgaaggtttgtgcctaccatgtactgtaattgagtcttaaatatgtcagagccgggcacggtggttcatggctgtaatcccagcactttgggaggctgaggcaagtggatcacctgagttcaggagttcgagaccagcctgcccaacatggtgaaatcctgtctctactaaaaatacaaaaattagccaggcattgtgctgcgcgcctgtagtcccagctacttggaaggctgaggtaggagaatcgcttgaacccaggaggcagaggttgcagtgagccgagattgcacccctgcactccagcctggatgacagagcaagactctgtctccacataaagaaaaaaaaagaaagaaagaatcttaagtatgtcagagtatggttactgttatgctgtatacctgttacatgcttggctttgaaggagagagcacttggaagcctgagcttacataataatcataatctgctcattgtctgagaaattgtgagttgttatggtttattctttttgacatttgagtattcttgctctcagaggtgcagcatttgtagcatgtaaactttaatcagagattatttcaaaagggaaagggaagctagagtcactaagaagaaataggctgggcacagtggtttatgactataatcccagcactttggggggctgaggtgggcggatcacttgaggccaggagtttgagaccaatctggccaacatggcaaaacactgtgtctactaaaaattcaaaaattaactgggggtggtggtgcatacccatagtcccaggtattcgggaggctgaagtatgaggatggcttgaacctgagaggtgaaggttgccgtgaacaaaggtctcaccactgcactccagcctggctgatagagggagactctgtctcaaaattaaaataaatacataaataagaaataaatgccagcattctttttacaataatgctttatgtagtgggaatgtgtgatcaatctaatagtcagtagaactacccagtggttgatgctatatataaagtaggaaatacgtaccctttctataattgattttaaaagtttctgcattaagcttacactcttttatttcactccatgtttcagtaaaaatcacaggacttgtttttatttacaatattataccattgtttgaatatttaatgggatttatattttaaaatgttttagttggtatagttattagatattctgtattaacctagaatggaaaattaaagtatgtatcttctgattcactgcatgtaaataggacctgacttggacatcgtttgaaatgtattccagtaatcgcgctggctatacatggtcccatacctgcccttatcccaacagataaatggtattcttctttatttattcatttatttatttatttatttttgagacagggtctcactctgttgcccaggctggagtgcagtgacatgatcttggctcactgcaacctcctcctcctaggctgaagcagttcttccacctcagccttgcaagtagctcagaccacaggcatgcaccaccatgcctgggtaatttttaaattttttttgtagagacggagtcttgctgtgttacccaggctggtcttgaacttttaagctcaagcaatcttctcacctccgcctcccaaagtgctaagattacagatatgatcactgtgcctggccccgcaaattggtcatttctgatggttgtctgggcctcaaagcctgagttcagcatagtgttttggcacgttgcaaagaataagtaagaaaatgttgttaagtggacgcaactattccacatgggatgatgttagatttgaagaaggaaaaagtggttcctcaattcctttcagattggcagttgcaatagtaacagaaccctcattgacatgaagagccaatgttttcctgtagtagaggaattattttcttgttttatttaattatttatagtgtttcttgattatgttcatgggggcattttgttttgttttgttttgttttgagacggcgtcttgctctgttgccaggctggagtgcagtggtgcagtctcggctcactgcaagctctgcctcctgggttcaagcgattctcctgcctcagcctccctagttgctgggactacaggcatgtgccaccacgcccagctaattttttgtatttttagtagagacagggtttcaccatgttggtcaggatggtctcgatctcttgaccttgtgatccgtctgccttggcctcccatggcatgttgtttttaaataacttctcttgctctatgagatgagaaaatatgtattctgtttgggactttcttactctccctcgataataaaagataaaaatttttatttttcattcactgaaacataaaaaaggcatcatgttttgtgcagactattaaatgttgattttaagatctgtgttggatggttttatatagctgtctaccatttatgagtttcatgtggaatatactaccatatcaagttttcattgtttaaacagctctactttgtcaagtattgtttacaattcaacaagaaacaagcaagcatttacaaatatacgtgcaaatatgtattcgtctgacaaccaattagtgaaattgaataagtgctcttgaaacaaacttgtttgatatcaagcttttgtgctagagtaatattgttgttttgactactttaaaagtgtttttatctggatgtggtgactcgtgcctctagtcccagctacttgtgaggctgaggcaggggaagatcacttaaacccaggagttctaggctgcagtgagctatgattgtgccactgtactccaccctgggcaacagagtgagacctgttctcttaaaaaaactttttttcagttgtggtaaaatacacaaaatttaccatctttctgagatcatttgctataaaggaatacctaagtctggattatttgggggtaaaaaaaaaaaaagagctttattagtctcatggttctgtaggctatacaagaagcatattgccagaccaacacctgcttcagataagggcctcaggaagcttctactcatggcaaaaggtgagggggaggtgtgttcagagatcacatgatgagagaaccaggtgacaggctcttctaaataaccagttcttaagggaactaagtgagaactcactccagcaaggatggcagcaactcattcatgagagatcaactcccttaatccaaacacttcccattagactccagctccaacattgggggtcacatttcaatatgagatttggaggggtcagtattcaaccatagtaccaccttaatttttttttttttttaagagaaggagtctagctctgttgcccaggctggagtgcagtggcgtgatctcagctcactgcaacctccacctcctgggttcaagcgattctcctgcctcaacctcccgagtagctgggattacaggcatccaccaccatgccctgtatttttagtagagactgtgttggccaggctggtcttgaactactgaccttgtgatccgcccgcctcggcctcccaaagggctaggattacaagcatgagccactgtgcccggctcaccttaaccatttttaagtttatagttccgtggcattaagaacatttacatttgactgggcacattggcccatacctgtaatcccagtatttagggatgtcagtacaggggcattgattgagcccaggaatttgagaccagcctgggtgacatagcaagaatgtgtctctataaaagattttttttttttttaattactgggcatggtggcacatgcctgtagtcacaactacttgggaggcagaggtgggaggatcgcttgagcctgggagatcaaggctgtggtgagctatggttatgccactgcactccagcctgggtaacagagtgagaccttgtctcaaggaaaaaaaaatatgtaattgtcaacactgtgtatcttcatacctcttttcatcttgcaaaactgaaactttttgtccattaaatacagatctagtgtcccttatccagaatgcttgggaccagaagagttttggatttcagatttttctgaattttggagaattacattatttacaggttcagcattcctagtctgaaaatctcaagtgctccaatgagctttttaaatttttttgtttcatgccaactctcacaaatttacagattttggagcatttggattaaggacactaaacttctttttttttttttttttttttttttttgagacggagtcttgctctgtcatccaggctggagtgcagtggcacgatcttggctcactgcaagctccacctcctgggttcacgccattctcctgcctcagcctcccgagtagctggaactacaggtgcccgccaccacgcccagctaattttttgcatttttagtagagacggagttttgccatgttggccaggatggtctcgatctcttgacctcgtgatccacccacctcggcctcccaaagtgctgggattacaggcgtgagccactgcgcccggccaaggacactaaacttctaactccccattatctcctctccccatcccttgccaaccacaattttattttctttctctgtgatttgccatggtgtcggtacctcatagaagtggaatcaaacagtatttgttttcttgtgactggcttatttcatttagaataatgtcctcaaagctcatccatgttgtaatgtgtgagaactcgcttctttttaaaggatgaataatatttttttgtatgtatgtgccacattttgcttgtccattcatctgtcagtgaacacttgggctgctcctacctttttagctattgtgaataatgctgatatgaacatgggtgtggaaatatttattgttttgtttcgttttgttttgttttttaaatgagagtctcgctctgtcaccaggctggagtgcagtggcgtgatctcggctcactgcaacctccgcctcctgggttcaaatgattctcctgtctcaggcccccgagtagctaggactacaggtgcacaccaccatgcccagctaatttttatattttttagtagagatggagtttcaccgtattggtcaggctggtcttgaactcctgacctcaggtcttgaactcttgaccacctatctcgggctcccagagtgctgggattacaggcatgagccaccgtgcccgtccttttattgtttttttttaagacagggtctcatactgtcacccatgctggagtgcagtgacgcgatcatggctcactgtagccttgaccttcagcctctggagtagctgagactacaggagtacatcaccacacccaactaattatttatttttggtagagttgagtctcacagtgttgaccaagttggtctccaattcctgggctcaagtaatccttccacctccacctctcaaagtgttgggattacaggtatgagccaccacacctggccacaagtatcttttttaagagtctgcctcatttcctcccttactgccttttgttgtgcttagttgagtttttgtagtgacacattttgattctctttttgtttcattttatgtgtagtctacagaatttgtttgggatgattatcagagggatttcatgtaaaatcatgaagttataaatatgtattttaaggtgataataatttaacatcagttggttacaaaaaccgtacttcttttcacctcaggcctctccaactttgttattgatgtcacaaatcgcatctttatatagtgtgtgcccttagatttttatgcttttgtctgttaaaatcctgtaaaagaataaaaactggacttatgaaccaaaattttaataatagaggcttatatatttgtccatgtatttatctttgctggagaactttatattttcatacggtttttagttactgtctagttccctttcttctcaatttgaagaatctttggtcatttcttgtagggcatgtcttatggtaatgaactttctcagcttattaatttcattaatttaaaatttgggaatgtcttaattcttccctcatttttgaattaaaattttgctggatatagaattctcatgtgatagggttttttttttttttttctttcctttcagcatgttgaataatgtcattctactaccttctggtctgcaagtttctgctgataatcttattgaggatcccttgcttgtcatgattcagtttgatcttgctgctctcgaaattcttttccattgttttttaccttaaaaatttgttttttgtatagacaggttcttgctgtgttccccaggctgttcttgaactcctgtcttgatccctccaaagtggtgcaattacaagcatgagccactgtacctagcctgtcttttacttttgacattttgaatatgtgtttccatgtgggtctctttggttttttttcctatgtggggttcattgagtatcttgctatcatatatccatgtcttcaaatgtgggaagttttcccccattattttttttgaaataatctttctgttccttttcctctctcttcttctgtaatgtgaatattgatttgcttgatggtgtctcataagtcccttcggttctgttaccttttctttattctttttaatttttgcttctcagactggattatttcaaataacttttcattaagttcactaattctttgttctgttattagagactgcttttgtactcttctagtgaatttttcaattcagttattttttcagctccagaatttgtttcttttcttccccccctccttttttttttaaactatttctatctctttgttaatattctctatttatgtatcttttttctgatttcatttaggtctctcctcccccccaccacctttctttagcttattgagtgtatttaggacagtttaaaagtctttgtctagaggctgggcatggtggctcacgcctataatcccagcactttgggaggccaaggcaggcagatcacttgagatcaggagttcaagaccagcctggccaacatggcaaaaaccccgtctctactaaaaatactaaaactagccgggtgtggtagtgcatgcctcttatcccagctactagggaggctgggcaggagaattgcttgaacccaggggacagaggttgcagtgagccaagattgtgccactgcactccagccagggtgacagcataggactccataccaaaaaaaaaaaaaaaaaggtgtttgtctggagctgaaagccattatcctaactgaactaacacaggaactgaaaacgaaatactgcatcttgtcacttacaagtgggagctaaacactgagtacacatggatgcaaagaaaggaacaacagaccttggggcctacttgacgatggatggtgggaggagggtgagaatcaaaaaattgcctaccagatactgtgcttattacccaagtgacaaaatatctgtacacacgcaacccctgtgacacacaatttacctgtttaacaaagctgcacatgcactcctgaacctaaaataagagttaaaaagaaataaaaaccaaataccccaggaacttgtctttaacttttgaactgggccagacaaccacaatcacaacatccttgaaaacagctgaattatgccagcgcctccaccggtgataattctttcagaacaacaacaacttgttttgttttgagatggagtctcgctttgtcacccaggctggagtgcagtggcatgatctcggctcactgcagcctccacctcccaggttcaagcaattctcttgcctcagctcccaagtagctgggattataggcacccaccaccatgcccagctaatttttatatttgtagtagagacggagtttcaccatgtaggccaggctggtctcgaactcctgatctcaggtgatccacccacctcagcctcccaaagtgctgggattacaggcatgagctactgtgcccagcctatttctatactttatgatatttgttcaaagtcgagcacttaaatagccagctgttctaatctttgtggactgattccatgatgggtaacatcaggagtatcagcctggtgtgaaggcttaaggtcttgttgaccttttctgtgtttgtatattcactgggcctatgtgaacacttttccccagattcctgggatgtatcagtgcttttagctgccttgatctaagagtggcatgttagatgttctgttgtgttcctctgccctttgtcttttgtccctctagcactggcagatcggtgacatccctgtagctctcaactaagccactcttcccatccgaactttgcatcaggtgaaacagtaatcagtcccatgagcagcacccccagacaagccagaacgatgcaaacaagttccactcttttccttctgtcatgatggagcatcttagaattaggtggattcctcccaacttggcctcaatgaggagggattggagcaagggcaacctctaaatatacatacatatatacattaaaaaaattttttctgtggctgccttacaaattattgttctttattttaatattttaaaaaatttcctatattgttttgagtgtggctttttctcgatggggcatttagttggctgccgcagattcttaactgcttgagagagtttgcgtctggttgaaattattacacagttgagttggcagcttctttcacactgtgatccctcccagattctgccggcttccttccctgagggcccctctgagatatagtcagggatagcttccctggactctagctggagaatgtgagtgcttacaaagctcttcttgctactgcttctactttcatattccgcactaaatctgctttagttctaggtaaggttaaatccttctcctgtaatctggattttcagttttttcagtgggaatgtgtgttcggaggcgggttttcctgcttttacacttggggaactcacggtttctcacctgtcttgtggaatttacagcggcgtgccacttcttttagaggatctgtggattctttctgttttcccgatatgttcctatggtggttcttggcacaaaagtccatggtgtgaatctccacatgttgttctgtccatccaagtgggagctgcacgttaatcctgtctcctatccgccatcttcctccctactttttgttggtctggacagggagcttgtttgttcagtcacaaaagtttattctttgtgaatcctattggcttctgttctccagttctccaggttcttaccggtttcttgagtttttacaaaggtactttggtcggtatgttgttcacttggtgttttcattgggtgatgtggacctggatcatcgtagtctgttatcttggtgatgtcctgtgtttttgaagcagatacacatgtttttgaagcaaaaagtgtcctgctttatgaagcagatatgcatcaatagaatttttgctacttctcttatttcaagcattttattgcagtgggatttgaaatgtgcactaattatacagacttggggaaaaaatttctcatgaggttgcaggtgcctctaagcaatgtgaatggaaaaccattttagggtcacaataaaataatgtgccatacctgtggaaatatggaatagtaaacgactgtcccgaaacccttaggaatgagaatgttggatttttttttaagacaaaaacttaaggatggataatgtaaatgtttaataattaaatagcaagaggtaaaggaggaaaacttttagttctaatatcaatataggccagtgttctcaaacttttatacttcaggatccctttatactcttaaatagaactctttgggcttctcaatcctatgtgcattgtatctactaataaaaatgtctgccacatacccatgtgtataagcatagtttatccttctttcaagtaaaatggcattgcaagaaaaagtggctagttcagtttataactctaatggtgttacaagtgcttttccttagtactactaatttacctctgaactgttttatgtcttctcacttgatcaatacagtatactaaaaagacatgctaaattttgttagtttactgttttatttatataacattctttaaatgaccaaattatagagatggaggataaatttgtggttgtcaagggagaggagtgaggcaagaaggaagatatttgtggctattaatagggtaggtagggtagggtaataccacagatccttgtcaaggaatattttgtattttgactgtaatggtggttatatgaatttatacatgtgataaaattgcatagaactaaatatacacacagatgtgcatgcatctgtagtgaaactcaggaaatctgaataaggttgatggattgtatcgatgtggtttttctggctgttgtactgtactgtagttagatattaccattagggaaactagatgaagagtatatgggagctctgttttatttctcaaattccgtgtaaatctataattatttcaacttaaaaagtgatacattctgttacagaagtgacattcttttgtcaattacctgtagaataagaaaaattgaaaagttaaataaagaagtgacattcttaagaactggcttttttttttctttcctttttttttttttaaaaaaaagtttaatttgtcgtgaaggcttagggatgaagaatacaatgactatcattgccttggttttcactaagtatatgtaagatttacttagtgaaatctcagatttcctgagtatatatttaagatttactagtagctacatccaccttgcttttctatcattgttgaaaatatcagcacaggcctgtgacatcttagtatttattttacgaaaatatttcacctcccacacctgctttaatagcattacagagatgcccaggactctgtggaccacactgtgataatcagtagcttaaagcttcagtctttattagctgaggaaaacaagtgctatgcttaagactgtgtaggaaattcagtgataggtctctgtcactgtctccagcgttttatattgtggtcttgtttgttggatattattgtacttctatgaaagtagagttgcagaagtttagagtgatataaaatatagaactcataaaagcaaaacatgggaattaacagtttgctatacctgtgttgtgcagtatgttagccatgggctatgtatgtggctatttacattctaaggattaaaatgtatataaatacaatttaaatggaaatcagtggttatagagtttgttttttgcaagaagaaaaagttctagacatctgttgtactatgtgcatatagttaacagtactgtatacttagtggttaagatagtaaattttgttacatgttttcttttttcttttctttttctttctttttctttttcttttttttttttttttttgagacagagtcttgctctgtcacccagactggagtgcagtggcactatctcagcttactgcaaccttcgcctcctgggttcaactgattcttctgcctcagcctcccgagtagcagggactatgggcgcaagccaccatgcctggctaatttttgtatattggccaggctggtctcgaactcctagacctcgtgatccgcctgccttaactttccaaagtgctgggattacaggtgtgagccatcgtgccaggccttgttacatgttttctaccacaaaatttaaattgaataaaattcatttaaataaacatttattttttcagtttcatcagtcacatttcaagtgttcagtagccacatgtggctaatagctaccattttagagagagtaaatatggaacatttataattatcccagaaagttctatttgcattggttgtgtagcacttaagaagacagttttcagctgggtggggtggctcacgtctgtaatcccagcactttgggaggccgaggcgggcagatcacaaggtcaggagtttgagaccagccttgccaatatggtgaaaccccgtctctactaaaaatagaaaaattagcagggtgtggtggcacgcacctgtagtcccagctacttgggaggctgaggcagaagaatcccttgaacccgggaggtggaggttgcagtgagccgagatcgtgccactgcactccagcctgggcgacagagcaaaactccgtccccccactacccccccagcaccccccaaaaaaagaagaagaagacagttctcaagaggttgaaggtacttggtctggactttaaggtgctatttttgtttctctggccagatttaagtgtcaaacatttgttaggtgaacgagtttctctcaattaatttgtaccctataatatctactaatgagaatgaacggggctggatgtggtggctcacccctataatcccaacactttgggaggctgaggcaggaggattgctagaagccaggaatttgagaccagactgggcaacattggcaagaccctatctccacgaaaaattcaaaaattagtcaggcattgtggtatgtgcctatagtcctagctacttggaggctgaggcaggaagatggcttaagcccaagaggctgaggctgcagtgagctgtgttggtagcactgcactttagcgtaggtgacagagcgagaccctgtctccaaggaaaaaagaagaaaaatgaataaacacacttatatatgcataaagagaagtttataaagagaaattttaaagcaaaattaagaacttgtataaattaataggaatagcctattttaaaacttattggtatagctatgtagtcttattcagattttaagattttaagtctttaccagctctaagatgatagagatagatttgcatctagcccctttacaatttcaaattttacattccaacattgtaatcaatctggaatttcttttggtataatgagttgaggatggttaaccacctttcttctaaatgattatttagttttctcaacacaatttattaattttggtatttttctattaatttgaaatgtttctaatacattctgcatatatgtgggattatttcagcattctctgtattactcattccatgtcattaaatgttcttctgtatcttttttaatgactgcaaaggattatacactgtggctgagtaagtgcttcttacatctatatctctttattgatttaataataaatttcttaaagattaagtagccagggcgcagtggctcacgcctataatcccagcactttgggaggctgagcccggtggatcacctgaggtcaggagtttgagaccagcctgaccaacatgatgaaaccccatctgtactaaaaatataaaaaaattagccgggcgtggtggcatgcatctgtaatcccagctactcgggaggctgaggcaggagaattgcttggacccaggagggggaggttgcagtgagccaagattatgccattgcactccagtctgggtgacagagtgagactccgtctcaaagaagaaaaaaaaaaagattaaaataagtgaaacagtcatctatcttaggccttatttacgcacatagcccacagcacagtgttttctttgtgctagatttctgctaatgctgttgatttaatttttattatcaaaaattatttagaactctataaaatagcagacttcctactggatattctggtttgctttgtattttgtttgtttgtttgagacaggttctcactctgtcgcccaggctgaagtacagtggcacaattacagctcactacagcctggggtcaagtgatcctccagtcttggcctcccaaagtgggattacaggcatgagccactgcacccagcttgcttggcatatttgtatttcatgcaggagaagctggaggacagaggttttctttattaaatttttattataaaataatcctactgaacattggaaagtaaaaacataatacagaagtatataaaataaaacctataagttgtatcctgtacactctttataaccgtctctgaagtagtcaatttaaaatttgctacatattttcttaagacatttatcttccttggttgttgtgtgtactatgtgcatatatatagtttttaaagttaagacagagtctttttatacttaaaaattctacaatttgcttttgtcacttaatattattatggacatctttccatgatgtatgttgacttgattcattctaaagattattctaaattctctcagtgactaagtacataatctcaccttttttatatatagacatttagaatatttccagtttttttgtttttgagtgtgttttttttttttttttttttttaaggaggggcccattgtgaatatattcacatagtgagctccctgaagtggaatcatagaatcaaagggataagcatgtttaaaatgtggtcagtattaccttacagttttttgttttgagatgaagtttcgcttttatcatctaggttggattgcagtggtgcgatcttgtttcactgcaacctctgcctcccgagttcaagcaattctcctgcctcagcctcccaagtagctgggattacaggtgcccaccaccacacccatctaatttttgtatttttagtagagacgaggtttcaccatgttggccaggctggtctcgagctcctgacctcaggtgatctgcctgtctctatctcccaaagtgctgggattacaggcgtgagccaccacacctggtaccttatacctctttgaaaatttggcagcttagttttttagtcagatttatgtttgttcacatacagtgtgtacaatattgagtttaatctttatggctgaatttagtttaggtgatggcagaatcttaaaacgagaaatggcatttcatctctgacttatatgtaaagtacttagaatagtacctgaaacctagtaaaagctgtataaatgttttatgttataattatttttgttagcttatgtccattgtactacattgtgaaaataggaaatacagattaattttttcacatgtctatggtttgaaaaccatcacatctggagtcttgttatacttgatatgctgtgtttgttttgtcttataatggaattcaccatttctgcctgtggttgactgtccaaatcactgtttttaacatcatcattagagatttaagggttatatgtacaccataaggactgttctcattggcttttcttcagtaacattattaatttacatcatttgcttggtttgctgtcactattgtgttcttatctccccaacaaataaaaagcattcaaaaaggtttattgaaacataaaattaataatgaaagtgagaacagatgtctgtaactcatcaacttggacagtatactggattgcagagtaaattctgtatgttcacccatatgtccttgaagaagtaaatatttgggatgactttgaaattattcgaaaagggaaagtacaaacagatgctctgattattattgaaatgatccttcattgatctgtccctagttttctgtgcatttgacatgaaacatggtcaaagtatgttcccactgaaattttgcattgtttttcaacaaagcatggtagtaaattaaggaaattattctagaataagtcattaaatgcagagaagagatcaaaagagtagaggcatcttttacagttgcactgcttacagcaatgataggtaacaagtcatactgttcctaagaagtttctaaaggcatccacagagaatggaaaaatgctctgaacgatcgttgaatgatctattggcaaaatttctttgtcatgtgccaccgttaagcattccatattgctagtggtataatggcatacattgtgacagaacaattacttgcatatgtggctgcattagagattgtgctttccatttgatgaaagtacttgtgtacagagtctgaattagctcttggcatatgtgcaatgtaaatataaaaagaagtactagatttttattttttaagtctgtttagagtagaaagcctatatagaaaataattctttgttttttttagtaatcactttcagagcaatgatataatctggaaaaaggcacattgggaacattgttgacagagccccagcaatatctgtgatcaggaagggtgttctttctgaacaaaagaactttatctttgaatgccaattcacatattgcattttcagttggctctatgttcccttatttggcttgagtgttgaaaatgttgttaaaattttgagtgaagtcaaataaggttgtcatgtatatttttagcatcttcaatgaaatacagtggattccctttctatttcaatagtacgacagctatgagagaacaaagtgttcctctaattgaagtatagaaagaggtaacatttctttatgtttttgtaagtgatatatttcagtgttatatttagtatcttgacagctagaaactcctgcttcagaataccaccaaattaaatgtgaatagtgtcaaaatatatcctaagatcaaagagcctcattactgagaaatgaccttatgaatacttgatttttttaaatttaatgaagaattaaattggtgctctcttttaaaactatattcagattctcaaatagaagttgaagaaatactttccctatctcagtggagccagaattaataagaaattcattccctgtgttttcttaagttaaaatagtcaaactttcagcctttcagatttcggatgtgatacatacacataaacgttgtgtctgaaacagtgctgaaactaatccatgataagaaaactttatttttagatcctgtttgacccatttattaattatttgatagacatgagatactttgctgccatatttttaggttagtggctagatttagtagaactagagtaggaaaggaaatcaatctgatgttgaaccttagtgtcagctacagagatggctatattaagattaccacgttgaaagattgccggatagcctctgtgtctaatatgaagccattaattttgttttttataactcattaaaaaaaagaaaaagaaattttgttttgttatttggaacgtatgatgaatcctgtcaagtatttcctttaaaattggtgatcccagctaaacgttaaatggtcaacagatgctaatactttctagatatattatttactttgttatcttaggtaagatacttaaatttttcagtccttggtttcctcattcatagacgtgggatagtgataaataaaggtgatttgggaatattttatctcatttaatcttcacaaactgccttgagaggtaggtgtgttgttcctttttacattcgtgggaaagataaatgagttgcccaaactaacaacagtgttcagtagcaattgttaggatttcagtccaagtcttgtggatatgtccattgttcttggtggcatttcattttaaatacgttacaagcaatttttttattcagtagcacacagtatattagtctataacatttggcatggatttacaatgaaaagcttatgtttttatcttcagaaaatatatggtaaatgagccgtgtgtattacattatcacttattctaaggttttatataaggttcttattggttattgatttttatgggatcatgtaaaaggattaaggtatgtaagctttggcaagattacagcaatatataacagttaactgtgtggactgctaattgtggctctgagatgtcttcctcaaggaaagcacaccgtagcaatagcaagttttctcatccatgtttgattttgtttgtggtttgggctatccatttcagaactagatgaattcacagtaggtcctcttagcattgataatttcaaataattgtacctagtctttccttcatctttttgtgctgccataatcgtgtatatgaatgttctggttgatgctctcaggagcgtcagcaatactgaatagagaggtaaccaccagagtcttactaggtcatgctttcctgtttctaaccatgatgatgaggcatgataaggcaatttacattggcaaatttgaaatcattgatgatcagagagcagggaaaattgttgtgaacctcacaggcaggttaaacaagtgtggagtgatcagcctgagatatgatgtgcaactcaaagatctagaaaaaaaatggcagaataatctgctctcatcctgtcagttttgtttcattgtactgacaaccttagctggcatcatggaccttgaagaggcaaggtgaaacacataggagggaaagttctgggattctttttctagcaacataatacatacttgtaaataaaatgccttaatgcacaaaaaaggaaaaatggttacacctagattttggattgctaatgtccttttatcaggagatttatggtaacttaaaaagtgttgcattagctggtaaagaagctcttgcctgtagtcccagctactcaagaggatgaggcgagaggatctctttgagcccaggagtttgagaccagcttgggcaaatatcaagactctgtctcttaaaaaaaattaaaaagttgttcaggtgctttgggaagccaaggcaggagtattgcttgaggcctggagtttgagcccagcctgggcaacaaagtgagaccctgtctctgaaaaaaaaaaaaaaaaaagaaaaaaattagtccggcacagtgctgcgtgccggtagtcccagctactccagaggctgaggtgggaggatccacttaaaaccatgagtttgaggctgcagtgagccgtgattgtgccactgcactctagcccgggtgacagagcaagaccccagttcattaatttaaaaaaaaaaaaaaagaaagaaaaggaactgtactgattttgagttactggatattgtaataaagttaaatttttaaaaagtagaatataaaccacattaataaccacttctgtaaacttttataaaacatcttgaactagaattgccatgccatattttttcaaaatattatattgttcttgccattttttgacagaccccttatccctctggacagaatgcaggtccaaccacgctggtataccctcaaacccctcagacaatgaattcacaacctcaaacccgttctccggtaagtaagcagaagcttgaaccaaattacattctctacctgtgtttgtgtgtgtagtggcttgggtttctttggcaaatatttttactggattttggaagtttgttccaaagatgatttattattatgactcctactattatttgttagctttgtattttcagaccttacctatagcaataattaaatttattgagaaaaagaagaggtggagcttttaaccctccactcccttttaatacttttctatagcatgatttttaagtctggttgcattcaagtttactttatttcagcttataatttttgttagttgtactgttcaaaattcaggtaagagtaaaatacaatgattttaggagtaaattgaatttcactaattaaattctcaaattccagtggttttgggaagcaggacttttgaatcagtgttattagatctgttctaaccatttaacagtgtgggtatatgcatgacatataccagtgagtgtattcatttattcaaatgagaaataaattgtgatacaaatgtaaatgctatcatcctctttgttcatcctttacatgaattgcaataagtactgccaagactgagaatttacacaaggttcatcctttgtttcacaaaagtatacagtggcttcagctctccattccttagaacatcgtttcctgccctgcatgattagctttggctagaaggtgcttctgtaacatctcacattgtgtatctcacatccctctttgtacctcagctctgtgtattcttcagaattcagggatatctttttgttccctgcccctgcctttttgcctggagtgcaggaatacctcattgcattagctcctattcatttcattttatgcatgaacttacaattgtttaaatataccaaagacttacttaaagaactaggagagcatagactgcaccaaaatgtaatctctttcttatcctttttctattttccttttccctgttgccctgttctccaatacctgttcttagatcctggttctccccagtgggtggaggaaccattctaaagaggtgggactttggtcctagttgcctgtttgcttgtctctttttttgctgaaatggtcaataagatgtctgatacaagttttgttatgagagtggtttggggatgtgtacacttgacttacttgggcctgagatctcaccagatcaatttagataggccctggttctaataattaaacatggaacattatggtaagctcctattgcaaagaattctttggccctctttctgtatacccccaaccctaatttctgattatcaaaaaagaaaatgaattaaatttacatggttagaactggcgcagaacctgactgaagagctgcatctctaaaccagtttttttgacagcccagcagaacagtgccaatacattgcacagacaactggaagaggaggaaggttttggaacagactcccgtttacaggtccttggctggaagaggctggataaaatactgcattgtaagcaatataacaaactgtacttcttgcaggcagtggtgcctctggcacttagtatttttgaccacatccatttattggctgatgaacagaaatgcattgattgcttcctctctgaaagtctaacctagcatggcagtttctgccaggcatagtggggaaaagaataacaaattgggtgggtgttctctattgggaattagtcaggaagaatttgggggtttagatttttctttattttaaacttgaagtgagatatccctttcagataaatttgaatttaaaagataaatttcgaggcttctttttactccctttcaattttataattgaatattaaggaggaaattgtctgtagttgtcagccatttttctgtggtcataaactcttcagatactatcctctatacaatttttgccatctgctctgctagtgaccattacccaccccattactaaaaatcacacacataacattccattacataccctaaaacaagtgcaagactagcagaccccagactactcttgcttcttgttttaggtttgattttctttattttgttatggggtttttttttgtttttgttttttgttttttttttgtgctgggagggtgaagttggggtctgaaatttggcaggattgcattttctgtttacgtcccaagttgtcatagtctagtctcatccatctcacagctgtcccatctggtgaggagaggtaagctgttacattgaggcagggcctcttcctgtggctttgtagagcagctaaagcttactccattctatttctgcattaataggccattggcaattgcgcagttttaggcttttctgttcttccctggacagctgcctttgcaatccaactggcttcaagtggcctctgtccttccttcaggttatctttgtgcctgtctttctacttgatgcttagaatcttagttaaattcatactgtggaaagaaaatcttttttaaaaataataacaacactgataagctatctgttccattttctcgttttactggaacttttaaacagcagtagttgttttttttttttaatagcctgtctaaagtagtgaagctattaaatacttaatttggagagggagacagtttggcttttgtagtaacgtaaccattgattatttttatattttgtggtgttaagtttcaaaattacatcaatgttatgttggccatgctcagttaccaactgtgcccagaaggggtgagtaagtgggtgggtggcattaacactggatccaagttcacagaaggctgctttcctttatatcaacagtcctcaccatcttaaagacccttctttaacaaaaagaaaagaaaaaagaaagaaaaatttctagttttaatatgagccagcagcgactacagtttgttctgttgcttacagctacccataggattaagactattgtcatttcaaatgaaaaactcaatagccaatggtgactagtgcaaaatagactagggtactttcctagggcactttcctactaacttaagttggggttttctttttcgcttttgtttttatatatatgtaattttataagatactcttcttgttcatagaaaattctcttttgactggaacattcaaaatgtacaaagttttagcttttattttagagccttgaaaatgggacattttctgtggaacagtgataagacaggtactgccatactcaggttaattttgtaacatggcccctctcttccattttcttcaaaagtgtcataaagaaacatttcactccactccctactttcataccacatgggtggtattgcctgttcttgtccatagtagaagtatgatgttttcttctcctaattggaaaactgaaaatacaagacctcaatttctttgaagagaaaattttctgcaagaactgtaactgccagttatcatcattctgaaaaactatattatattgattagccaagtatgatggctgacctaacataacccaagcttgtaggtcattaatgcacttttcattacttgaacaaaaggtgacattttagcttctgaggtgaattcttgacagagctgttttcagctgtctcctacattgtggccatgtgttctactgtaatttgttgaaattttaaaatgtgaactaatggtagttggggaagtaattccaaatgttttgcaaatcactattgcacataacttaaatgctgagcatgagagattgtttcttaatcttcaatctaattcatctgtagtgttaagctgacagaaggaagtctctatagaggaaataagagagccaaagacatatatttttgctccttaaatatattagataaaaaccctgtatatggtttacattaaacactgctttctaaatattttcttttactattaaagggagtggttaacattacaatagctaacgtattagtatccacaatatggctctacataccccggttaatattacaatagttaatgtattagtatccagaatatggctctacataccccaatatttttgtctgttcctttcagttaaaatgtattcaaacccaaatttggcctggtgaattgtttgatcctagaggtttagcagttaaaatttgcataggtgaaaaaactttttattttcttctgagttagtagaagagttggaatatatattagccactttcaagtactctatgatttagctgaggaattacatttctttgtgctttattcttaggtaacaataggtacatatacacagtgctttgctgttgtctatagtaattaagagatttgacttatttactcttttttcttatcaagcctataagaataccacttggattaatcatgttagagactgatgttctttactagctgtttgccttgacatgccttgtattaaattatattagttaaccgcatttaaacttaaacttgtgtgtgtgtgtgtgtgtgtgtgtgtgtgtgtgtgtaaagtcataaaagatttttctttaactccaagaaattaagatactgaaacttccatttcatggataagatatcccatttaacttaagaaaatttgcagttaattgtgttacgttttttacttcctgctggactttataattatctcctggctaggtcttgtaatgtaaaagctttctcatttcctccagctgtatcagttacatacagcatacttgattttcatgtttgtcttaatataaccacttaatttttcaaacttgcttttgccttattttagggtttttttttttttttaaataatcctatcagagagtaccttacatgcctaacagcatagcctgtttctctcccagttgataaatgacaaactattctgatagtgctgttaacctgttgaatcttagtacctgtctgtcactgtcctgcagcaaagctttgactgttttgtgtgttgttttttatttccccactgtgggttttttttcttttggcatattgtgtgaaattttggtttttgttgtggtgtttctgactctttgtgcctttccttttgtgtttgttttccctccttttctcagtttgcagcggggcctcgacctccccatcatcaggtactgtacccttgccccttcactatcacccttaactaatagatgggggctttagtagctgctgactcttagaatgctgccatcccatagaactactcaaattactcatttcaagagtagcttttatctgatataattcagctttctttgtccttcattaatctcactgcattttgttattaacaaatccatttgcctctgtttatggcacatttaaaaaatgctacagttttttttttcttgccaagcattgtttttaaattttacaattttgaaaaatttagatactaagtgtttatagattttgtggatatttgtagtaagttaaatttaactgaatgaagcaggcagcattctatgggttttctgttaacattccgatataacctgtattgatgtgtataaaatagcattagtatttctaaaaccacttaaactcagttactaacttagatctagtaataaattgattaaaaatcatgtacatccatttgctggatagaattatttttattattagaacacatagaaaatagatatcttaattaatttaaataactttatcctattggttttttaaatgaaataattttaattttttaaatgaaataatattaattctatcctattggtttcatacttctatcctattggaatctatttagaggtggcaagacagaaggacttgcagggttctccctccaaccccccagtagctttttatggggtattctgaaacattttcttctgctgaaagagctttggtttagtctgttcatattacaagctttactatgtaaccagctggttaggcaagtctttttctgcatctttgtttcctcatatgtaaaatggagataaataacctctgccttagaaatagtgtaagcatctgacacaaaacaagcagtcagtaagtggtaactgtctttaatatgattgttatggaacaaagtctggttggataaagtaaatgttaccagtatttgcctgtgttatcatatttacaattcttattactgagtaaatggatattgtttagttgaaggcttccagtgatttaatacctgactctgtttttcaaaatgtattccttccaatctggaggatgtaaaggcaaagcaaatctgagttattaaaggtactttgcaggaggatggctatatggggtggatggctattgtttgggtttcatagtgaaataaaacctcagggtattttttttaattcagagataatattgtaaagtattaatactttaagagcttggacttcgccatcagctagatctaggtttgattcttccatgttaaccaagtgttcttggataaatcatttactgctctccaccttagttttctcacctgtaaaacggagacagtaataccatgttgaaactattatgaaaagtaaattagataatgaaaataaaatgattagcggggtgtttggcacatagtaactaggacatagaattagtattactactactaataataaaaatattagtttcttatgtaaaagagtgtttataattgaaaatttagtccagtgccatagaagcatggcttaaattttaatccagggacaaggcaaatactcctaaaagagagagacgttggggatctttactcaagaagcagagtgaaaagaaactatttatttgagaaataactgcaaaggaattagggcaaaaacgttttctgatctcctttatgtaaggcacctgttaatttctttgttcacatgcttgtgtttttcaaaccttggtttattttcataagtcatttcagataagctagcctaaggtaaactgttagtagagggaattaacgttaccattgaccacaattattttggtggattttatacactgtagattgatggaatgatgagtgaattttgaaacaaaaacagtattgctgaataggccaggtacggttgctcaaacctgtaatcccaacactttgggaggctgaggtgggtggatcacttgaggtcacgagttcaagaccagcctggccaacatggtgaaattccgtctctactaaaaatgcaaaaagtagccgggcgtggtggtgggcacctgtaatcccagttacttgggaggctgaggcaagcgatcacttgaaccctggaggcagagtttgcagtgagccaagatcacaccactgcactccagcctgggcgacagagcaagactcccatctcaaaacacaaaaacaaacaaaaagaaccatgttactaaatagcctgggcctttcttattaagactagtaactcttttaaagactgttgatcaaaaaatttaagttcttaatgaaaatagaagaaactttaaggttatgtttctgctacttgggttcgataatagtggttctaaaattaggatattgtatttaagcatttgtagtgagctttgggaaattctgttctctaagaaaacttttatgagctttaaagttatgtggtacattttgtctttctttaattccaacaatcggggaaaatgttcagaaatctctgtgagaaaaggttgatttcagcccacattttcatgtgcagtaggactcagtaaagtgttagcagattagtcgtttaactgtatgatactgctcatgaatttatggctagttttgattattttaaaaatagaagtataagctggatgcggtgtttgatgcctgcaatcccagcaatttgggaggctgaggcaggtggatcgcttgagccccagagttagagatcagcctgagcaacatggcgaaacctcatctctgcaaaataaaaataaaaatacaaaaattagttgggtgtggttgtgcatgcctgtagtcccagctactctgggaggctgaggtaggagaatcacctgagcccaggtggtcaaagttgcagtgaggtgtgattgtgccactgtactcagcctgggtgaaagagtgagactttatctcaaaaaaaaaaaaaaaaaagtatatatgtttattatatttattatttatttcttaccaagaaacataattatcatctaacaatagttcttggaggtaagttcctaagatacagtataaattcagagcaatgatttttaattcagaaaattcaggtagctggcacttttttctttgttatcctttttttcctgaacaccagttaaattcttttcatcatatcacagagaattgaataaggatgtctgtacccttgcctcaggcagcaacagtaattaccttgaatagaggagaagaaagacatggggttggagtggcatagctgagcagggctaactgaaccggcattatgtgtggtataggataaattgttagaaagagtttgctattttgcatccacaggagatgtggggtcaatttggtttgtttcactatgggataggtattggcatttgggtgggataaccagttatcaaagctgccgtatataatacaattaatttagcatcgtttgggctttaaatgccagtagaatttccctagtgacaattagaaaacaaagcaaaacaaaagaaaaccaccactgtacatttccaaataccctccatggaaatgacagcatttcccatttgagaatcgcttactgaatctgtatttcacagtatcttctcttcagatctaaagtcaggtagcacctaaaccctgaaagatttacagaggagttgctcataatacagaacaagacatagagacttgcataatgaaatgaaagctgttggaggaaacaaacattgagtggtatacagagaatatacttttaaagggaagacactcatgtcctgggatattttgggttttacatacttaagacttaaagtggaattgaaggcagaaatggttttttcatcggtggtagtttgctttggccagtgaatagatttcttttttgtcctttattgcattattcatcagtggctgcctttctgatcactttacgtcctttcatgctttgatctcaatttattttttgaaggaatttgttgttggatgatgtttttaatgattgttgtttctaaagtccaatagcaaatatagtaactttttgttgatgcttagtaaaaattgcaaagtatgttctatagctgttgcaaagaaaaaatacaattatttaggtaggctttttggaattaattgcttgtgaaaagaaaacatcatccagtttagtaatcttagaacttaaatattttttctgtgtaagatggagttacttgaattcaagtaaacaaaaaataacaagattttaaatggtaaacattttctttgttcttaatggaatcaagaaactgctttgagtgtattccttggaacttcttttatttaaaaggtcttttaactctgtttggagggctagagctctttttgagtccccacaaatcaagtgcgccatgctccagttaggattatttcagccacatcttcttcctgatattactattagtttttgtcttttgtggagattcttcagattaataaggatgtgctattcttttggcattttataacctgaagagcttttagaattacagttttcttcaaagataaaacaagaaatactaagtcattttatatgcaaaacactcttggctttagaaatatgtcaactatttttgcactgatgcttgaaaatcccaaggtaattagaaactgaaagaacagaaagtacactcagaattatagcaagccacttggtataatttggattctggcctgtgttgtttattttgtgtatttggtcattaaaatctgtgtagttctggtttaaagttacttatgttcctgtccttattttactttggggtttcacaatagagatcaagtgttggttatatactatgactaagtagtcttttcattatgagaaagaccagggaaatagtattttaaagtgttcataggacaaaacactgtgcagttttttgatatatgattttggttcacatacttttcacaaatgctgaaaaatatgctgtattcaaagcagtgggatttagtgtaaacaaataatgagcttcataaaaccagcgtacactatcagcaggaggaggaggaggaggagtatgtgccataaagaaatgtcttacttggtggcaagcgttgaaattgtgcatgttttcctcttgtggtttggttctttttgtgaaaaagaaacttttgaaaagaactgctgatttatgtagatttctttttcattatgatccctaaaggtttctttactgaaagtttgtgatgttatatattcctagttgagatatatttgtgttactataggcaatttattagatttggaaagtaaaataaatgggccagacctggcacaacagagttaaatggatatgaatagcaagccatctcaagcatctatacgaccttatgacatcttaaattatgatcttatgaactttttgttttttggagcttggtacaagtgagtgatgggtggttttatctggtatctcattcacaaggagttgtatagtagcagcataaataatgaagaaaatatatgttgggagtcagtaaaactgggattcaatttcagcttcactacaaattatctttgggcctcaagtttctgatcttcaaaatgggtaaaatatgctaataaatgatataatactgagatgttttaataactgcatatatttcctatgggtgtggtgaggataaagtacctgcctatcacagtgtctgaaatgaaataagtccttggtaggtgtcagtttcctttagcagtgagactacctgcctttccccttttcccaagctattttttagcatgagtgaagtattttataaggatgctcatttccaagactctcccttatgatctgacagaacacctcctgttcctgacataaacctctagggtagcactgtgtaatagaatttctgtgatgatgaaaatgttctgtacttgtgcttttcactgctgtagctctactagctatatacatggctatagagcactttaaatgtggctaatgcagctaaagaactgaattttttctttttttttttttatgagacagagtctcactctgtcacctaggctggagtgcagtggcacgatctcagctctctgcaacctcctcctcccaggttcaagtgatttttgtgcctccgcctcctgagtagctggaactacaggtgtgagctaccacaccctactaacttttgtattttttgtagagtcaggattttgccatgttggtcaggccagtcttgagctcctgagcttaagcgatccgcccatcttagcctcccaaagtgctgggtttaaaggcgtgagccactgtgcttgacccggaactgaatttttagtacaagtagttaagtatggcttgtggctcctgtattgaacaactcagctctagggcttccatatcccgattcttagtgaaacctaaattatataatattgaccacatgccgggaaatatagaaaaaatttagaatggaataatctccattataaattaccatggattaacagattatcaaattgacacctgagtgatgtcccattatgtggactctttaaagcttgtccctttctaacttgccagcaaatcatagcactgttcttcaagagtacttcagacttttaaaagatattcaccaaggaaatttctaattgcagatgttagtttttcatcttctagtaggctgacctatatactgaagcatattttgtattgctttgcaagttaataaatataggcatgcctcggagatattgcagacttggtttcagaccacgacaatcaagcaaataactgcaataaagcaagtcgtgaattttttggtttcccagtgtatatatgttatgtttccactgtgctgtagtctactaactgaacagtagaattatgtgtaagaaaatgatgtacatatagtaattaaatactttctcttttttttgagatggagtcttgctctgtcgcccaggctggagtacagtggcgcgatctcagctcaccgcagcctctgcctcccgggttcaagcaattctgcctcagcctcccgagtagctgagattacaggcatgtgccactacactggctaatttttgtatttctggtagagacggggtttcaccatgttggccaggctggtcttgaactcctgacctcgtgatccgcccacctcagcctcctaaagtgctgggattacaggtgtgtgccaccgcacccggctggtaattaaatactttctggctaaaaaatgctaatgattttctcagtcttcagtgagttgtaatctttttgctggtgaagtgtcttcaatgtagatgggtgctgactgatcagggtagtggttgctgaggattgagatggctgtggcaatttcttgaaataagacaaagtttgtcacattgatggactcttcttttttttaatttatttgtttgtttttgagatggagtcttgctctgtcacccatgctggagtggagtggcataatctctgctcactgcaatctccacctcctgggttcagttctcctgcatcagcctcctgagttgcggggactttaggcacatgccaccacatctggctaattttttgtatttttagtacagctgaggtttcaccatattggccagagtggtcttaaactcctgacctcaggtgatccgcccgtttcggcctcccaaagtgctgggattacaggcgtgagctactgcacccggccagtggactctttatttcatgaaagatttctctgcagcatgtgatgctgtttaacagcattttacgcaaagtagaactttcttttatcattggagtcaatctcaaactctgctgctgctttatcaactaggtttatgtaatattctaaatcttttgttgtcctttcaacaatgttcacagctccttaccgggagtagattccatctcaggaaatcactttttttttgctcctccatatgaagccagtcctcatttgttcaggttttatcatgagattctcatgataaagtcagtcacatcttcaggctctacttttttttttttttttttttttttttgagttggagttttgctcttgttatccaggctgcagtgcagtggcatgatctcggctcactgcaacctccacctcccaggttcaagtgattctcctggctcaccctcccgagtagctgggattacaggcatctcccaccatgcgcagctaattttttgtatttttagtagagatagggtttcaccatgttgggcaggctggtctcgaactcgggacctcaggtgatccacccgcctccacttcccgaagtgttgggattacaagcgtgagccactgtgcccggcccaggcactacttctaattctagttcttttgccatttccaccgtatcagcacttactccttccattgaagtcttgaatccctcatagtaatccatgagtattggaatcagcttcttccaaatgcttgtgaatgttgatattttggccttctcccatgaatcacaaatctctcctctcctctcctctcctctcccctcccctcccctcccctcccctcctctcctctcctctctttttgggggaatagggtctcacgatgttacctgggctagcctcaaactcctgggctagaacaattctgcaacctcagcctcctaagtagctgggactccagtcgtacaccactgcacccaggaatattcttaatggcatcagcaatggtgaatcctttccaggaagttttttatgtagtttgcccagaaccatcagagaaatcagtatgtgtggcagctgtagccttacaaaatatacttcttaaataataaggcttgaaaatcaaaactactccttgatccataggctgcagagtggatgttgtgttagcaggcatgaaagcaacattaatctctgtatacatctccctcagagctcttgggtgactaggtgttttcccagtaagcagtaatattttgaaaggaatctaagctctctacaatggccttaaaatagccagcaaaccatgctgcaaacagatgtgctatcattctggctttgttattttatttatagggcatagtctgagtagatttagcataattcttaagggccctaggattttccagatagtaaataagtattggcttcaaattaaagtcaccagctacattagcccctaacagtagagtcagcctgttgaagctttgaagctttgatgccaggcattgacttctcactagctgtgaaagtcctagctaaagagaagtcaatgcatgacatcttgtttcaatagatggctgtttcatctacactgaaaatcatgtgtttagtgtaggcacttttatcagttttcttggctggatcttctggataacttgaagcagtttctccataagtacttgctgcttcaccttgcactttcatgttatggagacagctgctttcactaaacctcatgagctaaactttgctagcttcaacttttcttctgtagctttcttacctctcagccttcacagaattgaaatgagagttaggactttgctttggattacattttggcttaagggaatgttgtggctggtttgatcttctatccaaactgctctttctccatatcagcaataaggctgttttgctttatcatttgtgtgttcactggagtagcactttaaatttcctccaagaacttattctttgcatttacaacttggcttttgaagtagctttcagcctatctcagcttttaacatgccttcctcactaagtttagtcatttatagtttttatttaaagtgagagatgtgacacaagaccatatagaggccactgttcagttattaatttccatataatggcctaacttcaatattattgtgtctgctgaataggaaggtctaaggagaggagaaaaatgggagaggcggggggacaacagacagtaggtggagcagttagaacacacaactttcttaagtttgctgtcttctatgggtgcagttcatggcgctcccagttacaatgataacataaaaggtcagtgatcacacatcaccataacagatataataataatgaaaaaattgaaatattgggagaattaccaaaatgtgacaaacacgaaatgagcacatgctgttggaaaaatggtgctgatagactttctcaacacaaggatttcacaaactttcaatttgtaaagaatgcaatatctataatgcacaataaagcaaagcagaataaaatgagctatgcttgtactcagagcttttccccacatgggaatatctaatgtgattaaataggatttttctagttgctgaaaatgaaaagatgtttttcagagaatttctgttatataatttgttagaggtgtttttgtcttttcatgcttttactgagcaaagtcatgaaaaacgatatttcataattgccagcacgttcaaacaccatttgttagacgtttttgatgaggaagctttgggtaatgatatgaattattgcatctttagaaggatttttcgagaggaaacattttttattctggcttctagagtgtttctgggaaagtaagcaattataagtatgctaagttcagcctctgttttaaaagtatcctatcttgttggatctgcccaaaatactgcctcaaatgagagttttcaccttcctctgccatccttctggtgtattaataataaatccttgaaagatgaaagaagtaaaacagattgaaatgaagtttaggaggtgaattttatgttgtacatggctctcttttctgtgcctagctctttgcagcatttttatcagttacttggataagtgacatttatgtcaagttttctttttttttttttttttttttttttttggagacagagctctgtcgcccaggctggagtgcagtggcatgatcttggctcactgcaagctctgcctcccgggttcacgccattctcctgcttcagcctcccaagtagctgggactacaggcgcatgccaccacgcccagctaattttttttgtatttttttagtggagacggggtttcaccttgttagccaggatgggtcaggttttctaatgatcctgtagtttgacactgtcatgcagtcggtacaatctgaaatgatggcttgtttagccagataaattttcatagttacaaactacaaaatcctctatatgagcttcaaaacacaattgtaagagtacacactgaagtgaagaacacagcttatttagccaggttatgtataaagaggatttaaatgctttaaatgagtgtcagtaccaatcagtagtaaaatatcaaaactgctcctgtgattcttggtttcattaatggaattggagctggcaggaataagagaggtatattgccttttcactcagcaacaaatatttttttagtgagtgccaggtacattctgggcagaccccacctcgatacctttgtgttggaacaagattgaaagaaaagatcaagctcatttgggaattaaaaatcttggttggagggacaggatgctagggagagggttatgattgacttgaaacaaaaaatagtggtgtgaaaattggcagtaatggcagcgttcacataacttagtggtctgttgctgatggagaaggatttgacatctgtgtggttttagggatggacacgagacaagtggataggtgatatagggagaaaaattgggggccagtagaaggaagagttttacagtattagaactccatttaattatgaaaagaatttgtatcttaagttgctgaagtttcttatccctagtggtatattataaaagatattcagactttaggtggatggtgagactaaatggctccttccattcaggagagtttgactcttaatgattgttcatcactcagttgagaagaaaagaaatttgaaggattgcaagcagtttgggaaatcccatttatatattccttttaataacctatggattactgctatgcttgcccaactgagaatctgaatttcttgcattactattaaatctaattatgcatttgtaattgaatggtttggaaggagtacaaaaaggatatatatttttttttttttttgcatttctagtcattacggcttttctagaatctcttctggtgcacgtgtgtgtgtgtaagtgatcctgtacttttaagtggaaaacacaagctccagatagactattgttgtaaaaagtattaatgcagtgaagttgagcaaaagtaagtctgtaaaatggtatgccaaggatacgcttttagcatatgaacaagtttcagtcactttttgggagatagagaattggagttgtgtaggtagaagaaatttgttttcgtgagtaagcatgtgttttgtgaagtaacttgatggaaaatttttcttaccaggaatcagtcatgattgagggacatgccacccgttagtatagttggataaagatcctgctacatcctttcagtgtttgtaaagaaaagatttctgctggtttatgtgaaaatatgggggtattccatttcatgagaggtaatatgtgtaacagttaaaagtacatgcctataatctgactgtgttttagttacagatgggggaggcttccagcaagttatttaatctccctgttcctcagtttttacatatatcttatgacctgttaataatagtacttgccttcaaggtcatttatgagcatgagttaacatatatgttgactgggcacggtggctcacgcctgtaatcccagcactttgggaggccgaggcgggcggatcacgaggtcaggagattgagaccatcttggctaacacggtgaaaccctgtctgtactaaaaatacaaaaattagctgggcgtggtggcatgtggctgtagtcccagctactcaggaggctgaggcaggagaatcacttgaacctgggaggtggaggttgcagtgagccaagatcacgccactgcactccagcctgggagacagagcaagactccgtctcaaaaaaaaaaaaaagtgtatatatgtgtgtgtgtgtgtgtgtgtgtgtatatatatatatataatgcttaggttggtgctttacaaatacatttctctttagcttcaaagctgaattcttagtgtataaaaattagtatattggccaagcgcagtggctcatgtttgtaatcccagcactttgggggaggccaaggtgggcggatcccaaggtcaggtattcgagaccagcctggccaatatggtgaaaccccgtctctactaaaaatacaaaaattatccaggtgtggtggtgggcacccatagtcccagctagtcaggaggctgaggcaggagaatcgcttgaacccaggaagtggaggttgcagtgagccaagatcagccactgcactccagcctgggcgacagagcaagactccatctccccccgacaaaagaaaaaaaaattagtatatcaatataactacatatttagtggctttttttggttcagctatatgttaatattaggaatatcattagaaacactgtttttacttcaaagttactgaggaaattagtttcatactgttcagaaacctcattgaataagatgtaacctcagttattctggacaggctggttaaaagttttatcagaacagctggaaaatagtggtaagaaaatatttcacatacagactgttaaaatttttggaaaacattgcccgtatctatttttcttactctgcataagttaatggattcattttctttctcctctccttaccaccccgtaacaccctatttcttcaggcaacataggagtattttgacattatttgatgatagtgttaccataatagatgatcacctgtgttcatttgatacgccctttatcttggctgggctgccctctacagttgatttcaaaggatctttcagtattaagatttttatcctctgcctgtgttatttagcaatgcccagtaagttgaacagataatgactcttctctacttgaggcttgtatcattcttgtggctcctgatattaactacattataaaaatacttaagtttgttcctgaagtgttgtttacagatcacatgcattgatgcatgatagattctgtttgctttgtaattacgagaaatgcagtccagtaatgggaggtttactgctttattgttccttttagcagccaacaaaaaaatgttgtcaccaaaactgtgtcagtggagataactagaagatggttcctgtagttgtattgcatcccaggttcctatgttaccaactttgcctcctgtgctttcttttcatctccatcacctactctctgtggcctgcccctttggtttcccccatttattccgttctcctgctatacctttctggctgttgtttttctgtgacttaatttctttagggctatctttgccatggggtaggaaggctgaatggggatgagccttggacactagatcccagttcttccttttgagcacaagatcaagttacttataccatctgtgggtggtttgatgcctaagagtaggacaaaataagaccagagtgggcccaaaggtcgaagcttggctttatttggactgatagcaacgaatattttgctgctttatttattttggtgcaagaccacattttaagattgttattatagttctccattttagagctataagtgccctcttatatacctgattagttaaaaagagcaagcaagtctctgtcattaagagtctgatatatattgaaaagtttatttcttaggacttttacaaaaataacaaatgacacagatggcaagtagatcacagagatgctagacaatgccagatcatgaaatgggtgatcatgagatccaagagtaagaaccagtagtcacaactgtacttgtgccaccaagcagacatttccttgcacactactataacttgtggctattaataatcatagaggatttttgccactggatttcagttaaatgtaacttgattctttgattctatgtgtggttaaattctcaagtgaagaactgtcattctgattttctagtcttctttcttctcctattattactaaatagaaagatatttttgttgagctgcatgctatttcctgtcccttccaactgatctgtaagcttttccattggctttctttctgtttcctgctgctttcttgcttcatatttgaagggaggattcagacctatccaggtaacaaactactggttctgcatggcctctttataactcagtctgcttattattacattgagattgattgctaatgaatggatacattcacattggaaatttactattggtatattgtttcaaggcttttaatcttgcagtgaaaattataactacaggtactggttgccattttgagaaatttgaactctgctgattccagaccattcttaggcctgtctagattgtccacttttattgcaaactattctagaaggctcagtttagtatgggattgtgccaccttttggagaggaaaaaaactgcttagttcagcatgtgacaaccctacagatggtttaatttagcttgaccctgatggactgggtaaatattttatgatcaaagagattccttgttcttctaagtattttataaattacttgaacagcagtcttttaggaggctacttttaatttttaatgatttgataatgaaccacttactctttatcagagtcagttcttttatataatagagaaatatcaatattagctaccccttttgttatactttattatacatatatgtatgtatatatacagtatgtgtgtatacatatatgtatgtatatatacagtatgtgtgtatacatatatgtatgtgtatatacagtatgtgcgtatacatgtatgtatacatacagtatgtgcgtatacatgtatgtatacatacagtatgtgcgtatacatgtatgtatacatacagtatgtgcgtatacatgtatgtatacatacagtatgtgcgtatacatgtatgtatacatacagtatgtgcgtatacatgtatgtatgtatacatacagtatgtgcgtatacatgtatgtatgtatatatacagtatgtgcgtatacatgtatgtatgcatatatacatacgtatatatacagtcgggtcgaaaccaccctactgttttcaaatatgtgatgatactgataagagcttgccctagtgtggtatatttttgggaacccagcaataggtaatttattctttttatgcatattgtatttgtaattcaagttgaccagatttttattagtgaagaaaaggagacagtaaaatttatatattcccctgtgttaaaaaaaaaaaaaaattttttttttctccccttcccagtttttccagaggcctcaaatacagcctcctagagctaccatcccgaacagcagtccttccattcgtcctggtgcacagacacccactgcagtgtaccaggctaatcagcacatcatgatggttaaccatctgcccatgccgtacccagtgccccaggggcctcagtactgtataccacaggtaaagtatctttgaggcctaggtggtccagcaatagagtggaaattaacccggattcacatcagagggagctgggtggatgaattgtggtattagttttcggtgacgtgtgaactgttttgttggttacaaatctagcccttttgtgatttttcattatgctgtgtgaagatatttctacatctgtttacttaaaattttttaaaatgataaattgtttttatctacttgctttctcccatccctttgccacaaccaactgctctaaaatggactcagtgattatgctgttcctgaaatcctttaatgtcattgaaaagctactagcctgagattattttacagtgagctgatgtctgcctgtgcactgatatgttgtatggctttactaagctgcacctttctcttcattctcattgtatcttgatggcaagcaagcatttttaatgtgtttgacccaatcgctttacctcatttaaatgattctcttacacagagaactttactttctgtagtaagctactttcttattattttattatgtttttcgcccccagataccatattatttataaatattcatactttctcttttctagtaccgtcatagtggccctccttatgttgggcccccccaacaatatccagttcaaccaccggggccaggtcctttttatcctggaccaggacctggggacttccccaatgcttatggtaagtaggaaaagtcaagacatttctgctagttttttgtgtttatttaattttgttgcttggtgggttggtttatacaatgaggtttagtggtaagaaggatttttaaataacatgctgctaacagttctttcttgaaagctacttttttttttttcttccagaaatgggagtctcattatgttagtcaggctggtcttaaactcctgggctcaagtgatcatcctgccttagcttcccaagtagctggacctactggcacatgccactctgcccagctttaaaagtaattttttggctgggcgcggtggctcacgcctgtaatcccagcactttaggaggccgaggcgggcgaggagattgagaccatccaggctaacatggtgaaaccccgtctctactaaaaatacaaaaaattagccgggcatggtggcgggtgcctgtagtcccagatattcgggaggctgaggcaggagaatggcttgaacccgggaggcagagcttgcagtgagccgagatcacgccactgcactcagcctgggtgacagagcgagactccatctcaaaaaaaaaaaaagacagaaaagttactttttagagagtggcttacaagaggagtattatagaaatatatttagttaatgacatcttctttacaagctgataattctactggaaagaatcatgtttcagagttctgacatcttccaccagttcactgttacctagatttttactggatttttgccagtggcatgaatataccttatcctcctttcacaatctctttttctccaaacatttcctaccaccttacaccttaaagattttgttaatgtctttcttagtagaatgcaatttccatgaaagtagagatttttgttttgttcactgctatatccccagcccctagaacagtgactggcaggcacttggagaatatacatgccataactaaatataactcagtgaacctgtgattctccgcaaaattgtgataagatctatggcatgggggaggttttgggtattagttccaatgaaaatgccttgaaaaattaaaagtgtttttaatttagagagagctgggttgccaagattattggcatatgcgccaatgctgaactaaaaatgataaaaattacttacttcattcaacaaatttttacttcatattacatttctcttattccatggaaggtgaataataagggataaaattagtagatactagaaaaattaagttttgagattcagtaagcattgatctgttatataaccaacaaagcaaaaacttattaaataatcttaatataacaggataacttatccattaaccagtttcctaaaattgggattgtctcagttaagattacagcagaattgatttgattcaagtagcccaagaaggtttttttttttcagttttgaggtgaagtaggcaaagcaaccaaatgttacgtggctttacttcttttagagaagggaaaagttttctgttaccttggttgatattgtcttgggaaactgctatttcaaagtgatacgcaatacccttcacttatcctcagggaatacattccaagacccccagtgggcatctgaaacctcacatagtaccctatacataccatgggtttttttttttttttttttgatctgataaaagggctactaagtgactaattggcatgtagcgtgtacagcatggatacactggataaagggatgattcacatccctggtgacatgaagcaggacagtgcaagattttatcatgctattcagaatggcttgcaatttaaatcttatgaattgttaatttctggaatcttttgtttagtattttcagactggttgactgcaggtaactgaaattgcagaaaagggattaatactacattttatataacctcactaaatgtctcaaatatgtttatttaactcagctttattaagttgtatcattactatgaaatttgatattttcagaacaataatgtgttacatatatgtgagtttaaaagttacacaatatatatatatatcacccaatttttgacagcatattgcaagtgctgttgaagtattccttgtgtaatccttggacttacctttgtcaccatttttatgtaattctagtgcctttattctaggtccttattctgaaaacttaaatccaagtaattatttttgagagtaacaatggttgttactatctagaattttttaaatagaaaacaatgggattattaatcagcatgaacatgctgaaatagacagtgtctcccgttaatttctgtgttgcaaagggaatacaattagtcttctaatttacaacatcatttttaaagatgtcttactgaattgtaatctgcttttttacttagtgattatgccaatcactttactcagaaaatgtcatcattaaatttcctgctgtaagtctgtgccagccctctttattgcttttaatactattgtacaatatgtatagaaacagtaatgatgaatttactagtagagacataatgtgcagatttgaatgtacaatattataacattttggctttatttctattagatatataccatttttattcatttttatgaaaaagcagtatgttgaggtataattgtatctcagatattattgatgtctgttccctttcatagatatgctttcttccccagtaaattctcatgcagatccagtagacatcaagtgggcagttaatcatctagattaaaatattgtttctctagttttcttaatattagaaaaacaatcttaaaataatttatttcattatgaaagtaactaaattaatgataaaaatttaaaaaggccgggtgtggtggctcatgcctgtaatcccagcactttgggagaccaaggtgggtggatcacccgaggtcaggagttctaaaccagcctggccaacatgatgaaaccccatctctacttaaaatacaaaaattagcagggtgtggtggcgggcgcctgtaatcccagctactcgggaggctgaggcagaagaattgcttgaacccaggaggcggaggttgcagtgggcagagatcatgcccctgcactccaacctgggtgacagagcgagactccatctaaaaaaaaaaaaaatttcaataatatagagtgcataaagttgaaatagccagtttctctcccttcccatcctttaaagcaataacatttaacagtttgatacgtattttttttttcatttatatttaacaagtttttttaacttaaattaacatggaatatttatagtagtgtaaataataaaacttcctggttattgttttcctttcatactatattcatgggcatctttctatttcattatctatagaacttctctcatttcttttaaaatatacataatctatttttggaatgaatcacaatttatgatacctaatttttagtactttagtagagatggtgtttcaccgtgtaccaaggctggtcttgaactcctgagctcaggcattctgcctgccttggccttccaaagtgctaggattacaggcatgagccactgcgcctggccatgtttattattgtttctatggaaaattcaaggttttgaattttttttagaagacaggcagtgtgctagttattttgtggaatacaggtgttaagatactcttcctgccattcagtttcttatagtaagtctgttagatattgtgctgaggtttaaacagtgagaagaaatctaaatattgactgcaccattggtttcacattatagacaagtaaaatgaataaaaagtagagtaaaataaagtagaaaacatacatgactattaaatttataatttggccaagaagacctttaaagaaaactgccgtttactgccagtatcatttcatgttttaacaacaaaaatcatcaaataggagcagtcctttatacaaattttaagttgttaaacctctgtgtgacactggggcctgttgtggggtggggggaagggggagggatagcattaggagatatacctaatgttaaatgacgagttgatgggtgcagcacactaacatggcacatgtatacatatgtaactaacctgcacgttgtgcacatgtaccctaaaacttaaagtataataaaaataaataaataaataaaataaaaatacaaaccaaggttcacataaaaaaaaaaacctctgtgtgtgtgtttgtatttcatgattgttattgtattcattttgcaatacatcattgacactttttatatagactgaggtttgggaaccactgatttagaactgggatcagtaaactttttttttcagtaaagggctagatagtaaatatctcaggttttgcaggctgtatggtctctgttgcagctgttcagctgtgccactgtgatgtaaaatcagccatagacagttgataaactactgtacgtgggtgtcttccaataaaactttatttaaaaaaataaatagtggtggactagatttggctcttagactgtagttgacagatctttgatctatacaaatgtacttcattccatgcataagaaatttgaggtccagagacattaattaacttaactaattaataaatggtatgtaaaaattactcatttctagtggaataaaaatgtttttaaatgtttctgactagcttattataaatattatatatttataataatatactattatattagtagtataggcagtagtatattagtagtagtagggcagattttctactctgctagagctcacagttaagaagacttaatgttttgctaattgcatttaatcccactatattgagattatcttgttctgtcacatttattggattaatgtgatataccaggctcttccccaatcatgtaggctcaaaaatgtttcatgagaagaatccaggttttttttttttttgttttttgttttttttaagagatcaccttttggatcttatttcacttacctcaaaaaatatggtgaagtgagcagattgtgttgcttgcctggcagcatttgaaaccaattttggggatttgttttctgagttaatttctgagccagtgacataataaagtagcacataattgctaatttgagttctgctttgagaatagtttactcattgttagaggatgactgagattttttttttggtctttttacattgaacttactgaaatcatagtcatgccctctgcttagatcttttccaaatctgattcagcaaacctgattgatacctacagaattctggtactgcaaatcatggtgcttccaacaactttacacttgaaaagtgttatggtggtagtggggatgttgatggtgataatgaaagtgggccagccttatttgactgtttgcttagtaccaaggattttacctgtgtgaactaccctcgtacatatttttttccttcttgttacggtgaatcaattatccatgttctatggaaagccaatcttttatgtgtgtactggatcccatcctgtacccatttaaggctattactctagcaattctttctttcccacattgacaattttccccccttcctctgctggattagtgtcatctgtatataggaataggcacactgtttcattgacatattaaggaaagtttttctgattccatatttttgtccagctatagctcaatttttctgcttttcttttacggcaaaatttttaaggaaaatatttgtactcatggttttcattttccgtcttctctttcactattgaacccactcaaatcaggcttcacactcttcacctctctgcccaaacaacttttgtcaaggtcactggtgatttgtactttgaaaaatcttatttgacctcttcagcaccatttgatgtggttaagcacagccctcattcttgaataattttcttgatttcaaccactgccttggttttcatctctttggctggagttttcccaatttctgtgacctctaatagacatggaatgccccaagatttaaccactgggcttcttttctatctgtattcatttcctgagttatctagtcttgtttaaatgttgtttatattctgtgaattccagaatggataactgtaactcatacctatcctctgactccagatttgtgtcactttctaactacttgatctgtatttgaagatctggtaagcacccgaaacttgacctgtctaaaactgaactcttgatttttctgccccaaactctattccttcagcattcctcatcttagcaagtagtacctctgttctttcacttgctcaggcataaaactgaaagagttttccttgagtcttctttctctcacaccagtatccaattcatcagcaaatctataggctctaccctcaaaccatccagtatttgaccccttctccacacctctactccaaacaatttggcttgatagtaattataataatagtcttaagttttgaaagttaaaaacagctcattgggagtacaaggagtgggggaagaagataatttcaggcagatgggcagtacagtcaaaagttgaagagattggtgtactcaaaggataggagttaggagtaggttatagctagaacaaagatgtggattcaagaatgatagaaaatgtaatttggaacctggattctaagtatctggactttatcttaaggccatatgttctgagccttttttccaccccagtattcggaaatttgctaatcctttatgtacctccctatggcagtagttccccatgagtaaggagaagaattagatcacccctactttccaagatgatcagatatattcccttctgtccctgacaaaacccataaacaaacatacacatacacccttgtgtgagagtcacagttgcatgtggtaagcctcagaataatattttttaaaagcatcactatagcatgatccatgttttagaaagacaactgtggtgtggatctgtaggaaccgagtatttagtggttttcatattggatgtttgtgaatgtttgaagacattacatattttgggaataatttcttgaccacttcagtaactggaggagagctagtggaaaaagatgatgaagaatgcttagtgtttttgtttttacccttttaaggggattgtgcagagacacagtgtcattgctagttctgtagtgtttgacaaaataactgaatgcctatttaattttttccaactttttaggaacgcctttttacccaagtcagccggtgtatcagtcagcacctatcatagtgcctacgcagcaacagccgcctccagccaagagagagaaaaaaactgtaagagatttttattactttttcttattttaaatctaaaatctattcacttatcagataagtttacgtagtcattattcatctcaattcacaaattactgtgccttttttttttttattcttcccttatagtcacaccacttcacctggaggatttgtatgggcatgtaattagaagttgttcataccatttgcataatatcatctttaattattcactgagctaggtttgctacatgacaacatgtactccacctttagaactgggagggtttagtgggctaaggttttactcagtgtgaggaatttaagctcagttctcacatctagactctcctttaacaccagtctttttctttttttttttgagatggagtctcactctgtagcccaagctggagtgcagtggcgcgatctcagctgaactgcaccctctgcttctggggctcaagcgattctcatgcctcagcctcccaagtagttgggactacaggcacaagccaccaggcccggctaattttttgtattttagtagaggtgggatttcgccatgttgcccagggtgatctcgaactcctgagctcaagcaatctgcctaccttggcctcccaaagtgctgggattataggtgtgagccaccgtgcctggccaacaccagttttaatcagctctccattcaagtatgaattgacagaagaaaaaaatagcacaaggaaaaagaactgagatattaaggatagcaagaaaaatccttcctgtgaaatagatatcttttaagaaacaaaaaacagagtttagaaaatgtattctaattgttttttataatttataggggttttgtctttgtctaatgaggcaggcccaagagaattggagtgtagtaatataaaagtcaaatggcagaaaaattgtagaagagtggcttgcaattccttacgcaacagaacagacaaaatgggtgatctttttattcaagagagactcccacattcacacgagtaagataggtggggtgatttatagcaatactcttgaattactctaacttaataaaaattaatgaggttcaggccgggtacagtggctcacacctgtaaccccagcactttggaggccgagatgggtagatcacttgaggtaaggagctcgagaccaacctggccaacatggcgaaaacccatctctactgaaaatacaaaaattagctgggtgtggaggctcgtgcctataattccagctactcgggaggctgaggcacgagaatcacttgaaactgggagggggaggttgcagtgagatcgtgccactgcactccagcctgggcaacagtgtgaactgtatctcaagtaaacaaacaagaaaataatagtgaggttcaagactttggtttaaaacttgtttttatcattagaaacaaattacttgtgcatatatcataatgaacaggacatgacaatgtatcatgacactacagtcaagaaactatatgctttggtaatgttgaatcagcatgatagaagttggacttgaagaacactctcagaatgcagaaaaatgaatagaagaaatgaaaccggaagacagtagttacagatgtttctaaagaagaaagtagaataaatgaattaaagctatacttaaaactttattagaaataattttccatacctaaacaatagctggcattagaagtcttaattgaaggactcccctaaaagcgtccagatccaggtagtttcattagtgaattccttgaaattctcaagaagtgtggactgccttgattaaggtatggtggtaataaacaacagtgggtcctttatatcttagcactctcccagaatagaatgcctagtcgcagacacttacctcctttacagcaccaactccactgacatctttaagcatagggtagcctttaaaaaaattaaaataagaccatacacactttgtgcttattgcattttttcacctaccagcacatcttaatgattattctgtgtcagttcatgtagatctgcctcattctgtttttttgagacaaagtctcgctcttttcccccaggctggagtgcagtggcgtgatctcagctcactgcaacctccgcctcctgggttcaagcgattctcctgcctcaatctcccaagtagctgggattacaggcgcctgccaccgcacccagctaatttttgtatttttagtagagacagggtttcaccatgttggccaggctggtctcaaactcctgacctcaggtcatccgcccacctcagcctcccaaagtggtgggattacaggcatgagccactgcgcccggccagatctgcctcactctttttactggctgttaagtatttaattgtaaggacgtaagataatttttttttttaaatggagtcttgccctgtcgcccaggctggagtgcagtggcgcgatcttggctcactgcaagctccgcctctcaggttcaagtgattctcctgcctcagcctcctgagtagctgagactacaggcatgtgctaccacgcccagctaattttttgtattgttagtagagatggagtttcatcgtgttagccaggctggtcttgatctcctgaccttatgatccgcccgcctcagcctcccaaagtgctgggattacaggcgtgagccaccgcgcctggccgacgtatgataatttttgagctattctgttctcgatcaacctttttccagtctttgctggaaaaggcatgattgcagtcagcattattacatttgtatataaggttgttgtcagaataaattattcctaactcgtagggtatttatattttttattttggtaaagaacttcagagaattatttacagcgtttaaaactttattctacgccaggtaccgtggttcacacctgtaatcctggcacgggaggctgaggcacgagaatcgcttgaacctgggtggcggagattgcagtgagccgagattgcgccactgcactccagcctgggtgatagagcgagactgtctccaaaaaagaaaaaaaaaggaacttttatctatgcagtaactttcatatattaaaagtattttatgaaacttgtatgttaaatatggtaaataaaatcagtcttacaggttcttacaaaacaagtataaatattaatagtttgcctttttgacctagaaatccagccaactaggtttcattttagcttgttattctaattagttcatgtcagagctaatggcctacatttatctgatggatctgtgattgaaataaagtcaaatgtggtgattatcacctttgatatttgacaggtttcccagtttgcacctttaactcacttatatgcctataaatttgctacacagacactcatctgtacatatgtcattttatttaaccttatagataagaattcgggatccaaaccagggaggtaaagacataacagaggagattatgtctggaggtggcagcagaaatcctactccacccataggaagacccacgtccacacctactcctcctcaggtaagacagagtgagctgtaatggatggcactatttgttcactaacctctactgaactcttctttcttctatagccactttctgtacttttcatttccatcagttgtctcgcagcctcgaatatctaaatggtatttaaacagacatgttttttctctttgcaaattataatatttttaaatttttattggtaatatatttatgtattgttttcacaatcagagcacaggtgaggtgctgccactcttcttaatgaactatcgcatgatgccaaaaggagctgcattcttgtagaaacctcatcattaaatgagtatttcacatttcacatggaaccttaggatttaagtgctgcaccttttgttaacgcaaacattaaggttgagaatttaacatttttaccaaacagtgttgcttgagatgatttcctgtgttattgagagcatattaggatgtataacaggtatacttcttaccttttagaactacataaatgagcttcttgagtgcagagtgtcttctttaattacagtcatcccttggtatctacaggggatttgttcaaagatgccccctccacagtaccaaaattcgtggttgttcaagttcattatgtaaaatggcgtagtatttgcatataaacagtgcacatcctcccatatactttaaataatctctaaattacttataatatctaatacagtgtaagtagttgtcatactgtagtattttaaaatttctattgtgtttttatttaaaaatgtttttttctaaatattttttatccaccgttggttgaatctctgaatgtggaacttattaataaattgtcagttaggcacctttttcttcctggtgaagaatgtggttatcataatctcctaagatgttactttcttgtttttagaaatcaagatattgtagaggaaactggagtttagtaaactataatagagattagattccgcaaatctgacaagatttgtatttcaaggccgggcgcgttggctcatgcctgtaatcccaccactttgggaggctgaggtgggccaaatcacccgaggtctggagttcgagaccaatctagccaacatggtgaaaccccatctgtactaaaaatacaaaaattagctgggcgtggtcgcacatgcctgtaatcccaggtactcaggaagctgaggcaggagaatcgtttgaacccaggagacggaggctgtggtgagccgagattgtgctgctgtactcaccagcctgggcaatagagagagagagactctgtcttaaaaaaaaaaaaaaaagatttgtatttcattcctcctatgtcactttgcattttgataaatgatatagagacacgtggttttcagatcttaaaaattatctaaagtgaagccaattgcaggtgcagtggcacatgccgatagtcccagctatttgggaggctaaacaggaggatcccttgattccagcttgggcaacatagcaagatcctgtcccttaaaaaaaattgtctaaagtgaaagcctaatgtctagaaacagataaaaagaaagctattaaggagtagggggctgctctctttgctcttttatgcctggatggtaaaggggttccttggagcccagtttacagacaagtgatatggatgatcacatagaaagcatttcagaatgatagactattgacttcattttagtagtacagacaaaaataaaaagttcataaaaatattcttaaatatcaaaatcacaaacagctggctgagtttagagccccttggaaatctgtggatttgagaaagacttaattttggtcctttgttgtaatgatatgttttctcttggaaatgatggtatctggctgacatttatctcagtctttcattatccagatgagtatatatgtccatctggacatgtgtgttgtaaggtcatgttaataattcttcatcactcctcattattcccctagggacattccaattttggaatgattaagcaggtcttatatttagtctcttccctggaagtgagcatgggataagcaaaattttcaaattgaagtaatctatatatgtgctctgttaggtgggggcacactatagcaaaactttgcaattagttgatcagtgcagtcaaattttagtctgtattttcaaacatattaaaatgttactactgtcaagccagataaaggatagacaatcctttgttgatttctgtttaaattctcaatttggacatgtatgtgtctttttgcacttaaatgccctgtggggtgtgattggttttctgtaactttccaagcttggttcccaccctcttctggtatccctctgtgtttagctacagacatctttttgttctgtgtctttccccagagactgtggttctgaatatgagtgtatatttctctataatcataaagcacatcgaatctacactttcaacagatgaaggccatcagtcaatagtagtaatttggtagttctttttgggaagtgtaacatcagttataaagcataagtttattaggtgaatttcatgcttttaaatccaaatgcatgaaattcatggaatgaacgaatagctttttaacagagacgtgtactagagatatttcattttcctcttaagaaaaacagtagcacaagcataatgatgacaactgacatttgacctcattttctggagcatcatagaaaggatgcagtggctcacacctgtaatcctagcactttgggaggctgaggcgggcagatcacttgaggtcagaagttcgaaaccaccctagccaacatggtgaaaccttgtctctgctaaaagtacaaaaaaactagccaggggtggtggcaggcacctgtaatcccagctactcgggaggctgagacaggagaatcgcttgaacccgggaggcagaggttgcagtgagctgagagcaccactgcattccagcctgggcaacagagagagactgtgtctcaaaaaaaaaaaaaaaatgttgacccattgtttcagaagaagctagaaatgtttagttatgtgtaaaaaagctgcaagttataaatattggcaactaatttccttaacaaaatagcaatctgccagccaaagaagactcattagatttaacttcagttttactagttttcaattttgacatcaatccagataaatacagaatcatatctggttagaagactacagatgagacagccctctgcatcagaatttaggattcaacagtaaatactgtagtattggccttaaagtacctgctttgagttagacataattgcttatgctgtggataaccaagcctttccctatcaccgagggaagtcccagtctctgtaaagggaaacagaagacctgttactaagatctgactggtgcagaggtgaccaagtggggcagaattgtagcacagataccagagacccattaatggtggtggtacatgtgaaatagaacagggaagaggtttaaaactttgacttggaatcagacataactgggtttcatgtgtgggttccactgcttagctttgtaactttagcccaattactttatcccagagcattgctttctacatttaaaaagtaaaacctatcacacagagaggattaaatgagacaaaatacttaaaaattgtttaagttcagtgcctggtgcgcaatgaatattcagcaaatatctattactaatattacaattattattatttcaggaggcacagagaatgactggaagaacgtgggaaggctttaccacagagacaccatttgatctaattttcatgggtattcacaaaatgaaagggaaaggggtattgaggcagaggaacagcatgtgcaaaaatgggaaattagatgaagggaggctattattatcatatttcaggtgagaaattcattgaaggagaggaagccagttggagagatgtttagcaattagttactaactagataaggactctaaaaaggatgaccatataatttaccatctaaattggggtgattgtggaaatgaatggcaatgctattgttaatgccagcacagcaggcgtaatcagtactgcacatgtaaatggggatgcaagttttctccagatgtaagggagagagagagtcagggatgcctcttcatgtttaaaaatacgtcttttgtagtgaaacataatattgagtatacatggggaagtttaaagagcgggatataatgagtttgcttttggcaggtggtcaagccattgtgatttttatctaatttggtcttgaggtttctctgtcaagagtggccataaaccaggatagccactctctaagagagccctgaccagggaaaagttatgtttgggtgtgtttgtcaggtgagacataatgaggaagtgaaaccaaaatgcatgaaacagaaaaaaatttactacttcctaatcccagagaggttagcagtgctgatgggaggctgataggggagctctgaagacagcagggaactcacccagcaggtggagagagagagaaagacgactcgtgggactgtccctttattaaggtccatgtcctcccttaggcttccccactggagttatggatttgctagtttgaagaaaacactttcaaagggtgaacttacttacaggactctggtgttaaccattaggttttatcatggtcagcagctatgggatatgttgtgttttgggtcagtgagatgaggaacaaacggcctctttcacaagcaactacacaggaaggaaatatttgaactaggccaaatgtgaaagggtttcaaaaacatatgctagccctaaaagtggatgccgagggagcaattatattaaatttgtgacacaagctatgagttaattgagggaaactgcattgggtttctgtgaggagaatggagaggagaaacaaatttttgctgctgctgtttttaccctaatgagaagtagacagaatttgaaactgttcttcaaagtcttaaaattttctgtgggttagctagtagagattttgtatctcacatatttaggaaatatgcatatgtgtatatacatgttccctgtatatacacattggatccctgtatatgcacagaggatcacagtgcgtagatggaggtgcatggctggatatcatggctcacgagaacacttgctgctggttttcactgtgttacttagatttatgaccttgggtcagaacattaagttcttaaaacccctattttttcatctgtaaaatgaggaattgtacgaaataatctgagagttcccttttagttcttacctattaaagtgggaaagaaggaagaattttgttactcgctcagtatcaaatctctcaactcctgatgatgacagtaaggcataaggaatatccctgtatttagaaatatgctagctattatgcctaatagtcttcattgaaacccggtagtgtaaaaataaatacatgatgccatgtcaagattgtctacttccaaataggatgaatggtggatcaaaaatcacttaattttttttttttttttttgagatggagtctcactcactctgtcacccaggctagagtgcaagtgcggtggcacaatctcggctcactgcagcctttgcctcctgagtagctggaattacaggcatgtgccaccacgccagctaatttttgtatttttagtagagacagggtttcatcgtgttgacccaggctggtctcgaacacctgacctcaagtgatctgctcgcctcagcctcccaaagctctaggattacaggcatgagccaccatgcccggccaaagatcacttaatttttaaaaatgaattatgtacctttcttccttgatatactctttttcccccctgcttctagaattattattgtaatgaaacacagttatgacatgggagagagtcctatgctatggggctttggggtaggaaattatggattgatagcgtatcttaggaaagatacaatctctcctaccatttgggaaaattactaaagtcagcaggttattcagtcttttgttgagctgcttatgaagttgatacctgcaaaccttaaattccatgaccatttattaattacagttgacccttgaacaaaatgggttcgtttatatgataatttttttcagtaaatacattgggaaattttttggacattgtgataatttgaaaacttccagatgacatattgcctaaaattatcaaaaaaagaaaaatttaggtatgtcatgaatacacaaaatatatgtagatactggtctgtgttttcatttagtgccataaaatatatacaaatctattataaaagttaaaatttatcaaaacttaggtacacaaatacagaccatacagagagaccatacagaccatacagagagaagtgtcaacagacacaaatatgcaatctggacatggtggtgcacgcctgtaatcccagcactttggaaaactgaggtggaagggttgcttcagcccaggagtatgagaccagcctgggcagcatagcaagaccttgtctctcaaaaaaaaaaaaaacaaaaaaaaaacaaaactacaagaggcaatattacatcctaacttcataaaattaactgtagtacatactgtactaatgtaattttatagccacctcctgttgctattttagtaagctcaagggttgagagtatccgcttaaaataccctgtgacactaatcatctccagatgagcagttcatctctcctgtaaattgtgcctcatagtaaaaagtaatttctctttgttgttacatattttttcattgtgcttagtgcattgccataaaccttgaataacaccatgggacccatacagagtgccaccagtgatgctggcagtacttccaagaggcagagaaaagtgctaacattacaagaaaaagttgagttgcttgatatcaactttttgatatcaagatatgcttgatatctaccatagattgagatctgcagctgtggttgaccaccattttagacagatgatttattttataaacagatgatgtaaacttatgatactgataaatacagcatagtattggaaatgtattttctcttcctgatggttttcttaaacacattttcttctagcttacattattgtaagaatatagtatataatatataaaacatacatactgagaaaaaaatatgttttatcggtaaggctttcagtcagcagtaggctgttaccagttaagtttttggggagtcaaaagttatacacagattttcaactgtgtggggtcagttcctctagctcctgaattgttcaagggtcaactgtagttcatttcatggtttagcagtaatagtttcctagaattgggtctatagcttcggttatgatattcatgttatatgttaatatgtgcagtaaatagttacattcctgcatgaagaatttgaaggtgatacctagtataatgtaaacaaatccaatcttttaaaatttcattttgtcatctcagtcataggcactgataaattaatagcattctgtaccttaaagcatacaggtatggtttttgttttagtggtgactacgataaaaatagtggttactaaattaaattatatttttctttatctttaatgaaataacttatcattagtaacctcccttgacttaaatggttcttttcaataatatgtaaagccttgtagactttaaataggtatctaaactggggtggattctctcaaaagtttttaaatgggacatttgaaaagtgtcctattctctgttcgtcatgatgagcagagatccttgctttgttatgctgtttcatagattaaaatgaatttgtatacactatatggtttgatagaggaaataagatctagtgtttggtagatcagtaaggtgactatagtttacgataatccattgtacattttgaaatagctagcagagaagaattcaaatgctcctagcataaagaaaagacaaatatttatctttgaattatgtgaatgtgttaaatttttgtgggtacactgaaactgtgtacatctgttacgcagtaataaaaattattattattatttttttgagacggagtcttgctctgtcaccaggctggagtgcagttgtgcaatcttggctctctgcaacctctgcctccctggttcaagcgattctcctgcctcagcctcccgagtagctgggattacaggcatgcaccaccatgcccagctaatttttgtgtttttagtagagacggggtttcaccacattggccaggatggtcttgatctcctgacctcatgatccgcccacctcggcctcccaaagtgctgggattacaggcgtgagccaccacacctggccaataaaaattatttttaaggaatttgcacacagaccatcaaagacctactcattgcttatctgacagaataaaaaacagtatcttgtttaatttttgtgtattctgtgaagttaagaagttttcgatgttcaccagttatttgtgggtgtatgaattatctgttgtacacgtttcttttgggtgatgatttttgtctgacagatttataagagggctttacatgttaaataaatactttgacatatgttaacatttttttcttgtttgatgattgtgttttagctttgttaatcgtgccttctgtcatacggaattgttaaattttctgtttcatttatttttttgagacagggtcttgtctgttgccctggctggagtgctgtgacacagtcacagctcactgcagccttgacatcctgggctcaagcaatcctcccacctccacctcagccttctgagtagctgggactacatgcacatgccaccatgcctggctaatgttttttattttcagtaaagatgaggtctcgttatgttgcccagactggtctcaaactcctgaattcaagcgataatcctgcctcagcctcccagatttctgctatgagccactgcaccagctgaattttttttttattttgaaacagagtctctgttgcccaggctagagttcagtggcatgatcttggctcactgcaacctccgcctcctgggttcaagtgattcttctgtctcagcctcctgagtagctgggattacaggtgcctgccaccatgcccggctaatttttgtatttttagtagagacagggtttcgcctgttggccaggctggttttgaactcctgacctcagttgatctgcccacctcagcctcccaaagtgctgggattacaggcatgagccaccgtgcccaggcagaatttatttttgatatatacacttatatatcaaaatgcacttagattagttccacatctttgcaattgtgaattgtactgctataaacatacgttttcaaatctctttttcatatgatgacttcgtttcctttgtgtagatacccagtagtggggttgctggatcaaatggtagatctacttttagctctttaaggaatctttgtactgttttccatagaggttatacattcccaccagttttacattcccaccagcagcatataagcattcccttttccccatatccatgccagcatctattgttttttgactttttaataatggtcattcttgcagcagtaagatggtatcgctttgtggtttcaatttgcatttccttgatcattagtgatgttaagcatgctttcatgttgtttgtaggccaatttatgtatctttttttgagaaatgtctattcatgtcctttgcccactttttgatgggattattattattattattattattattattattattattattgctgatttgtttgagttccttgtagatttccttcatcagatgtgtagtttgcatctctatgggttgtctttttactctattgtttcttttgctgtgcaaaaggtttttagtttaattaggttctatttatttgcgtttttgttgcatttgctttggggtcttactcatgaattatttgcctgggctgatgtctagaagagttttttccaatgttatcttctagaatttttacagtttcaggtcttatatttaagtctttgatctatcttgagttgacttttgtacaaggtgagaaatagggatcgtttcattcttttacatgaggtttgccagttttgccagcaccatttgttaaatagggtgtctattcctcaatttatgtttttatatgctttgttgaagatcagttggctgtactttcttggctttacttctgggttctgtattctgttccattagttatttgcctacttttataccagtactacgctgttttgttaactataaccttgtatgatttgaagtaattgtgatgcccccagatttctcctttttgcctaggattgctttggctacttgggcccttttttggttccatatgaattttaggatttttttttctgattctgtgaaacgttggtattttgatgagaattacattgaatctgtagattgcttttagtagtatggccattttcacaacattgattcttccagtctatgattatgggatgcatttccatttgtttgtgtcatctgtgatttctttcagcagcgttttgtatttctccttgtagagattttcacctccttagttaagtatattcctaggtatttcattttatttttgcagctgtggtaaaaggtattgaattcttgatttaattctcagcttggtcgttgttggtgtatagcagtgctactgatttgtgtacatttattttgtaacctgaggctttactgaactcatttatcaaatctaggagtcttttggaggagtctctagggttttctaggtatacagttatatcatctgcaaacagtgatagtttgacttcctcttttccaatttggatgccctttatttctttctcttacctaattgctctagctaggacttccaaaactatgttgaatagaggtggtgaaatgtaggcatccttgtcttgttcctgttgtcagggagaatgctttcaactttttcccattcagtatgatattggctgtggttttgtcatatatggattttactattttgaggtaagtcccttttttgcctacttggttgaggattttatcataaagggatgctggattttgttgaatgctttttcagcgtctattgagatggtcatatggtttttgtttataattctttttatgtgatgtatcacatttattgacttacatatgttaaaccatctctgcatccttgaaataaaacccacttgatcatgataaattatctttttgatgtgctgttgcatttggttagctagtattttgttgacagtttttatatctgtgttcatcatggaaattggtctgtagttttctttttttgtgtgttctttcctggtttaggtatcagggtgatactggcttcatagaatgatttagggaggattctctctttcccagtcacttggaatagtttcagtaggattggtaccagttcttctttgaatgtctggtagaatttagccatgaatccatctggtccaggctttttttgtgtgttggaaattttaaaattactgattcaatcttgctgcttgtcattggtctgttcagggtttgtctttcctctgatttaatgtaggagggtggtatgttccaggaatttatccatttcctttaggttttatagtttgtatgcataaagttgttcatagtagtctcgagtgatgttttttatttctctggtgtttgttgtaatgtctccagtttcatttctaattgagcttatttggatcttctctcttttcttggttattctagtgaatagtctatctattttttcaaagaaccaatgttttgtttcattgatcttttgtaatgctttttttgtttgtttgtttgaatttcatttagttttgctgcaatttctgttatttctttttttttttttttgagacagagtcttgtttagtttgtgcttgtgcttgtttttctaattccttgaggtatgacattaggttgtcagtttgcactctttcagactttttgatgtagacatttagtgctgtaaactttgctcttggcacttcttttgctgtactccagaggttttgataacttgtatcattattatcatttgattcagataatttttccatcttgatttcattattaacccagataccatgtagaaacagattatttaatttccatgtatctgtgtagttttgagggttccttttgcccccaagaactttaaaaatcattttcttaagccctcttaagtctgccttcaagcttttattttgagtgtccgggtttcctctcatcatttctgaccttggcaacctttcattgctttcaaggatgttctctattgcagatgtgtattgtcttgtcaggtcagtgtttaaagaaaaaacaatatttcatcaatctgaatgctgttagcccaagcatacaccctctagtttgttaagttgttctgttattatttactcccttttgcatcacatattaaggtttctgaagggatttgagtttgtgaccccttcgttataaactatttcagggctaggcgcggtggctcatgcctgtaatcccagtactttgggaggccaagctggggggattgcttgagcccaggagttcaccagccctggcaacatatcgataccctgtctctgaggcaggaggattgcttgagcctgggagtttgaggctacagtgagctgtggtcatgctactgcacttcagcctgagtggcagagcgagaccctgtctcaaaaaattgaataaaataaaatatttcaacaggtgtttgatgtgctctccttgttttttttttttttttttttgtaaattatactgtagtctacctaagttgctgaggttctaagcctaggactcacctttaaatcctcttaatttcactctccacagtcattacatcagcaagtcccatttgactcattcccaccaccttcactgctgttattgtagcctaagccactttgctctccttagacaacaggaactttctcactcatctctctgcttctgtcttgcctctcctctgttgattctgtacacaacagcccaagtgagtgatctttttaaaacataaatcatatcacaccgtttccccacaaaatactatccagtgtctcttcactattgactaactgtccatacaaaaacatacaaaagtccatattcatagaatttttgaggtgtgtaatggggattatgggaactacaagatgagatttgggtggggacagtcaaaccatattagtatagaaagaattagtatagaaagaactgatctatgtggttgatgcctattgtagtccttacatcctgtaattcctgcattagaattcagtggaattattgttaccattatattattgctatggtcattatttattgttttttattgcctttgtattaaaggaggtgcttgttatggcatgtcatatattattatattatgagaacacttcagagcttcaggttagatacccaatttttgacttgatctctgtactcagttatttcacaagccctacaacctcaaaactggagttcatggttttcctctaaccaaacccatgacttccaaaccttatgtctcctccagtgttccctttctcagactggcccctatctcagaaaccagaaacctaatgtttttctttttacccctctctcctcatagataccctctctaccatgtgtcatcagttacctaatcaagcccagtcagtttacccccaacctttaagtaaaattaagtaactgccccccattattaccaccaaaattatttcccttggactactgaagtaaccttgaaaattgcattcttgtaactgctgtttccttgctctagttcattctccatgcagtggtcagaattatctttataaaatatcagccaggtgtgatggctcatgcctgtaatctccgcattttaggaggctgaggcgggaggattacttgagcccaggagttcaagactagcccaggcaaaatactgggaccccatctctacaaaagatagaagaaaaaatagctgggcatgttggtacacacctgtggtcctagctgcttaggaggctgaggtggaaggaacacttgaactcaagaggtcgaggctgcagtgagctgtgattgcaccactgcactccagccaaggtgacagagtgagatcctgtctcaaaaaaaaaaactaaaaaataaaacacaaatctgattatatcatattgctgcttaaaacctggccctggcttgccattgctatggggataaagaccaaaaacccttggtctggcctgtaaggcctgtctgcctgactcctgcctgcctcatttcacaccagattcccctgttctttctgcatccctcttaccttttacataagggagttgatcatggaatactcttccttttagaatcttcgtacatgtgttctctctgcatgagatgcatctaactgcccttcctcctacatgccaacattcacattgattttttgaaagtcaacctgaatgttgcttactcagaatatcttcctcacatacgtcacaaagtcagaaccccagattatgggtcatctttgtactcttaactttcccagtaaagcatttatacctatagtgattaaatgattaattttgtggtctataccatatgtttcctttgatagaatataagctctgtgaacccaggaatgttgtcttagccatgagtagattcatagtgttttgtacaagttaaacatcaggaggaaatacacacatattgacacacaccgttctaatgagagaatgggagaaattcctacgtaagaaagaagcatgttttggtagtttttcctggcatcgttaagtatattattgttttgcttctttttttttttttttttttttttttgagacggggtctgactctctcgccaggctggaatgcagtggcgcgatctcggctcactgcaacctccaccccccgagttcaagcaattctcctgcctcagcctcccgagtagctgagattataggtgcctgccactgtgtccagcttatttttgtatttttagtggagatggggtttcaccatcttggccaggctggtcttgaactcttaacgtcgtgatccacccgccttggcctcccaaagtgctgggattagaggcgtgagccaccttgcctggcctttgttttgcttcttagccttcatagtgtttctcagtggaggctatacttgtttatccacagattttatatatgttaaatacatgaggtatttatacaggattattttaaagtcattgaatgggattcttatgatgacagtaaatcaactctttgcttatatttatgtaactatttgaagtctctggctttctctaaatgaattacaatacaggtcagcaaatattttctctagtgggccagatagtaaatattttagactttgcagccatattgtctcttttagcactcttcgattctgccattgtggcacaaaagcagttatagaaaatatgtagatagatgggtgtgtctcttccaataacatgttatttatgggcaccaaaatttgaattttatataattttcatgtgtcaagaaatactgtttgtctcttgttttccccaccaccccgccaacatttgaaattgtagaaacttaccttgtgggcagtacaaaatcaggtatatggccccaggattgtagttgttgacccttgtctataaccacctctgtacttaagtattctgtcatttatgtgattaaaatagaagacaaaagaaggtgaccccttttttgtgcaaaacaatgtgcctatgtaaagaaaaatgaattttgaattgtgcaaagaagtattaaagaacaaatttagattctgttgcctgtttacttaataggtaaacattatgtttttaaaaaatgaattcctccagtatgtgggcctaagcttaccatgatctcttgaggtcaatactttaaatttagtatataaatctttgagtaggttctaaaggagaatttataaagaatttttctcaaacactatcaggaatctaatatcttgccctcccttaaactcttttcactctagtttataagtgagaaacactttattttttttccttgtaccaatcagaaccttgattttgaaaaatttgacaggggagtttaccatttacataattgatgagctgttgcaacagtgtgcgaagacttgctaaatgaccctgaccttttaactctgacttccttagcatctttattgagttattttatattttggtagtgattgcctttccagaatgattttataagttttcattcccaccaatagtgaaagtgactaaaatgcagtggctttgaaattccttaaatatattcttaactgtctagcttaatttcttcatatgtatcaaaatgcatacagcattggatgtgatgttttgtgtcacagtacttggtatgtttcctgatttttctgacttattgattagtaaaatagttcatcattattttttctttgggaagataaggaactcctttgttatagactgtttgtttgtttgtttgtttgtttgcttgttttcgagacggagccttgctcttgttgcctaggctggagtgcagtggcgcgacctcggctcactgcaacctccacctcctgggttcaagcaattctcctgcctcagcctcccgaatagctggaattaacaggcacctgccaccactcctggctaatttttgtatttttggtagagacggggtttcatcatgttggccaggctgatctcgaactcttgacctctggtgatctgtctgccttggcctcccagagtgctgggattacaggcatgagccacaacacctggcctggttgagttacttctttaggagagaagagatgaaattggaggttaaactacaatttgacaagattatcctaaattaaaactaattctgaacaagactaaagtattgaattctggcggggcgcagtggcttacgtctgtaatcccagcactttgggatgtcaaggtaggcggatcacaaggtcaggagatcaagaccaccctggctaacatggtgaaaccctgtctctactaaaatacaaaaaattagtttgggtgtggtggcgcacacctgtagccccagctactcaggaggctgaggcaggggaatcacttgaacctgggaggcagaggtttcagtaagccaaggttgtgccactgcactcctgcctggtgacagagcaagactccgtctcaaaaaaaaaaaaaaaaaaagtgttgaattatatgttaatacgttatgattttattagtactgttggaggcttataaaatgataaagttgaaggagactgtaggatctttagttctacatttcatagctgtgagacctgagaagtactttcccagcatttgtggctatatacctatgtactggatacttggatttcaaattgtaacttaacaaacatattatctcactcctttcttacgactctttatacatagattctttctaggactttgttattttaaaatgtccatcttttatatgattgaaggtattttagatggaaaaatcattgactctagtagccttttactgtcttaaacatcttactttttctttgaatgtcatttttgtgacctacttttagcacttaccctgcccccccctttttatttggttattaatttcccaggcaattggagtagttaatatttttttccttttaggtaaatgatacaatttacaaatctttttttcctgggaaatgtggttaactgcttaatgaatgctaaataacatggagtgtttcctttgttccagatctcttttcagcctatagaactgaaaaatcggtatttttagttttagctgtgaacctttctattgaatttcagtaaggcatttttttcccactgaaactaaggattcagagtaattacagcagtgctattttctttatttgtccccgtgaaaacagtaactctccatttttttatatagaaatataattttagtagtcttcatttagaattgtggaatatgaacattttcttggtctaatgaataggtgaaatgatagcattttccctatttctgtctattattctatataagccttatatagtcaaatataaatttcatgttgtacattctgaaaagcatagttacttaaatgatatctatcatcctaaattgtatgtgtccatttcattttatattcccattttaagtgacacttactgacttgaaaatattttttatcaactctcactttttaagtgtctctgtttgcccacactcacccacatcttaatctccccatccctactccccagaaaaaaaaaaagtaaaaagaaaaatagaattgtgcagggagctctactctgatagcactgatagaattcgttgtaggatattatagataccaaaaaaattgaccttagatctccgaggagagacactgctttgtttcgtggcttgtgtaacctcaaatcctgaatgaatacctgcctagaatgtgatgtagaatgaatgttcatgtcctctcttgtgtaattctgttccctctaagttgagcaatagctgtgatttttctcaacctatcctgcttggattttgatggccatttttcattctaatacaatgcctgagtgaaaatgagtttccttatatctctgaaaaacccaatattttagtcaagatttctgattctgaaaataccatatttgacccagaacctgtagacattttatggtaaaattgctttattacatactttcaaagttgcatttcacctgtatgattacatggataagtagcaggaatcatttttcaatattgttttcttgaatctgtaaccgcttttcagcctcattacattttctgtttgtcctgctttgctaggtaatttatacatgaagttgaccaaatccttcttggtctttgggagggtgttaaattccttctcagatgtgtcgtctattgttaggttgacaagtcggcttgtccttagaaggaacactggggaataaattgtgctaatgattgttgtgctgtcttctcttgctgtggttaatagtaatcatttcttttccttcctctttttctgctgcctctttctttatcttccctgacttcccatgtacttttgaatttattaaattggactatatattttttccttgctttccttttttaattttgtgatctcctgtgctctactgtcttccctacttgcttgggttccatgttgctagtttttatgttcgcacgctcattatcacccttttttgtacttcaaatcccagcagctgcccagccaggtccccgagcacagccctgtggtttatgggactgtggagagcgctcatcttgctgccagcacccctgtcactgcagctagcgaccagaagcaaggtttgtgtatgactgttttcctccctcttatctttagtctcttttttattaattacattgccgtcagcattcaagagtaagagtacagcatccaaggattatttagacacccacctttaaacaaagctttgaggcagaaaattaaagtattctgcctctaggaaactaaagtagggatgattggtaaaattatttcatacatttgtttaatctctcactgttagtatctgtatacagtttaaaggttagctgccttaaactgccctttaaaacaaggtgggaagtggagggagaaatcctagcatatattactttacaagaacaatacagtttagcttatatattcagcatgtccctaggtatcttgctattttaaaaaagaaaaaaagataaaacatttcttcttacaagtttgggcttctatagccacatttggagatggagccaagttccaatcccggctccatcatgcactagttatttggtcttgattgagccactgaccttgtgtgtctcagtttcttcactgatagaatggaataaagacctatgtgcttgacaggattactgtgggaacatgcctatcacaggaaaagtgcttagtaaattatagtcattaatgctgtattaaggaatagtacactaaggtctctgctcctattgaacttgaacatgaaggtgccaaatgtttgttgaaataaatactgtgcctttgggaatataatagaaaacttaaaggaaatctaataccagaaagtgggatatcatagtctttctttcctgcctagttgtattttaacttgacctttgctaaaattgagagagaattctaaacatagttcggggaagcaagtaactttgaccctgctttatgtttcagatttctaaaaatgattggatatcaatatggaagccatgtaccttcttactttcttgaattatttattcctccaaactatttgtttattctatagctctatagttagtatatagattttctaaaaattattctttttttttttttttttttttgagacagagtcttgactcactgcaacctcctcctcctgggctcaagctattctcctgcctcagccgcccgagtagctgggattacaggcatgcaccaccatgcccagctaatttttgtatttttagtatagacggggtttcaccatgttggccaggctgctctcaaattcctgacctcaaatgatctgcctgcctcagcctcccaaagtgctgggattgcaggcctgaggcaccatgcccggactaaaaattatcctttaaaaaatatttaggaatggcccataaaatagatatatttaatattaaaggtttttgggtagactgcaagttagtcaatcacatttataaactttctgaaagatgtacttctaatacatgatttcattgatttttacatcaaacaaagattatgatatgtgtttttagtatagaaatttcattttccccctgagtattgagaagcctgatactcttgaacagacaggtcctatactgtatttgttatataagatagttttaaaccaaaagatagttagtgatccctaatgtggcatgcttcaaaaaactgcactgtcaagaacttctttcagcaacattttgagttaaaggagaactcctgcatgcttcaagcgaattctttaaatagtaaagccatttaccttgcgaaattacagactgtagaccaaatgtggaagtcgacttgctaccttcaatgataaagtcgttttgagtcaaaattcggaatgtttttaatcttagtggagaataattctcagagtatttcccttcaaaacttcattgcactttcgcaaatgtgtaatctttttgctggttagaattatgctaagcatattgaatacttcccatgcaaagaggccttaaaatatatcttctgtgcagactttctctgtagctgtgccaggatttttaaaaaatttatcacatactttgatgatgatagttctgtccttcctgaagacagtattattgcgtttgccattattttgtgaaaaataatgttaaaatttttagattatgagatccctgcattttgtcatatttaggcccagatttccagacaaggaatgcagacttgatttcctctcaggtttttgtttttgttttgcttagtggaaatttgaataacaacatcaacatatctaactggtgtataatataggcttaattggaaagtattcaggttaccttgatgaaaagaaaaacttgtagtattttaagtgcatttcagaggttataactaatgctctggaattactgttatcttccttttagtaccaactattcaccagaaaactaactctctttctttgtttctctgtttctgccttactccctttctctctccctttctctttctttctttctttctcttgctctctcgttctttctttcatctctctctctctcttttttctttcttggctagtcaaacagtaacatttctaatttcttccatagcctgccgatagctaaaatattactgttttcagagttttttttttttaaccaaatttatgtaatgttagaaagggctcactatttttttcagagaaaatggttttttttctttacactgaggatttttttttcttttttcttctattttgagacagggtttcgttctatcacccaggatggagtgcagtgacacgatcatggctcactgcagcctccacctcccaggctcaagcagtcctctcacttcagcctcctgagtagctggagctacaggcatgaaccaccatgaccagctaatttttgtatttctagaggcgaggttttgccatgttgtgtaggctggtctcaaactcctgagctcaagcgacctgcctgctacggcctgccaaggtgctgggattacgggagctacctcagccagccaaggagtttttaaaaatttccttcttcactgtagattccttttgaaattagcatataaaaactgacttttctcaaagattgttatattactcccagaaacaacagtctctacattttgcagattgtttttttctttctcaatagaaatgtctttactgagagtttgtactcagttacacaatctcatgttaactctaaagtctccctcctgcttgattgacttaagtacttctgtttccataagcctcccctttcctccaaaaagttggaagaatgtgggatttgaaatcattctcagacttgagcacttgctacttatatgactttgggcctgtgactgatctctaaaaccctcagtttcctcatatgtaaaataggcaaataatttctaccccaacaatcgtggttgtgagaattaaaagggacaatgtatgtatggtatttgacccagttcctggcacataataagtgcttaacaaatgttagctgccattattaagcttccggtttctcagagtttttgacatgaagagctagaatatttacatgaaggccaaggttccagacaaatctaccattttacatttgtttggcaccttatgaagacatagggaatacttcacattggtttgtagagagaacaactgttgaatgaattaaaatttttgcttggtattgatagtacacagctgaaatgattgctatttactgagtgagaaagaacattaaatccattgtactgaggatatggtatggataattaaaggagttagttggtgccttagtcttaatcttagtgcctgttgaaagcacctagtgtgttcagtgaatggtattctgtttgtaattcaaccattcatagcagtgttgttcatttgggactctgctggcatttaggacctattctttgtcaagtgagactgtacctcaaattgcaggatgctcagcattcctctctctgcttattaaatgacaatagcatcttctcagtcattgagagacttgtgacaaccaaaagacaacccagtcttggtcattgattccaccaccatatgagaataaaagggagcaattttattcttcttataaatttggcactctttatggaaactacagctaagcaaaatgaaaaagtatgtgtctgattactcagagccattattaataagctgactttcccctatgcacatatgttagtactaagcatttttttaagttaccaaattgggttctacatagagttttgtgccccactaaaaacaaacaaacaaacaaacaaattcttgccagatgcagtggctcacgcctgtaatctaagcactttgggaggacgaggcaggaggattgcttacgaggcaggaggattgcttgagctcaagaattcaagaccagctgagtaacatagcgataccctgtctctacaaaaaataaaaatattagccaggtatggtggctcgtacatgtggtctcagatacttgggaggctgaggtaggaggattgcttgagcctgggaggtggaggtcacggtgagctgagatcacaccagtgcactccagcctaggcgacagagcaagactgtgtctcagaaacagaacaaaacatatcttttattacaaacaactttccatatcattaaatactcttttaaaaacatattttaaatattgcatagtatgccattatatgcccagattatcatttctttaataaatctctattgttgaacatttagttgatttccttttttctccttttttcttgtattataaatagtgttgccttaaatattctagacatctatctttgctaaccctttcatgattattagaaaaattcttaaagctggaattcctgcaaattcctaaagatggccaaactttttataatagaagtctttagagggataaaataagtgtttttttttttaatttagctctactgtgtttttagctttctgcattttcagctttctgtattaaagctttaattagtgggttaaaggacttttattttagaatgaagaactcacaatttgttttgttttgttttgttttgtttgagatagagtctcactccactgtatcacccaggctgaagtacagtggtgcgatgacagctccctgcagcctcaacctccagggctcaggtggtcctctcaccttggcctcctgagtacctgggaccacgaatgcacaccaccatgcccagcttgtagaaatgaggtcttgtagtttgagacctcctgggctcaagtgatcctcccccttggcctcccaaagtgctgggatttacaggcatgagctcaccatgcctggcctaagtttttcaatactagatttttctgaagtgtgtatagaagtttatcaatcataggtctacttttgtttgattttttactatcagaaattgtttcccaacattaataattgaattgacatactcttattagatatttaatgtgagaatcaatttctctttttctctctctctctgtccccccaccccgctccccctctctccttctccccacttttcttttccctttttcattttgagacagcgtcttgctctattgcccaggttggagtgcagtggcatgatcacagcttgctgcagcctcgacctcctgggctcaaacgatccttccatcttggcctcccgagtagctgggtctacaggtctgcgccacctcacctggctaatcttttaattttttgtagacaaaaggtctcactatgttgccgaggcttatcgcaaattcctaggctcaagagatcctcccgtctcagcctcctaaagtgctaggattacagatgcgagccatcacaccctgccctatttttaaatttactgcatctaggtttcagtcagtggtcataaagggtgttagtctgataagctttcacagtggtattatgtaatctgggtgacttatttactccagtgagctggaaattattttcatcaaagatattttgataaatacatatttgttatatatggtgtgttccatctagaacgaacatacacacacacacacacacacacacacacacacacacacacacacacacacacacacacacacacacaaaaaaaataaagacaagttttcctgaaatatttttgtctgttgccctgtcaacttagtctgagggatttggcaatgagagcctattgattctatttcatcactgcagtaactaagaaaagtccaattttagaagcaccagcttctgtgcctataaataaaagtatattttaaggctaataagtgtcattacagtgaatgaattaataatatcttaatggtaatatttaatacctatttatctgataaactgcatatttgctttcacataattacaatttattgtaaagactcactttcattgatgtataaaaaattctgttggagaaagtagtctcagtttaggttgtcttttaatagtgcttgaatcttttgttgtcatttgataaacatactcatgagtatatgtttttccatggagcctgtttattgtgctaaggaagcacaaggctggaagccagtctaaatctcctttggtttcctccactcagggatgaatcacatatcaatttacctggaatttattaataaaaatgtggaaattattgttaattattgttccttgtgtttttctggtacccgcattatgatgaccagcttctcttctctctccgtctcattctctctatatatacacagatgcatttttgtatattatatcaaactatttcatactatgaaacactagtattttcatactatatgtatattgttttctttttcattggatttattcgtgtattaactttgttttctccttaattgttttacatgtaaagacacaagatatattttgttttttttgttttgtttagagacaggatcttgttcagttgcccaggctggagtgcagtgatgcattcgtagctcaatgcaacctcaaactcctgggctcaagtgatcctcccacctcagccttttgagtagttgggattacaggcatgtgccaccaagcccagcaatttccatttttataccttacattatttctggttatatacttccattgagaattgaagggtaaattaatttagaaactgatttttatcagttactgagaatagtttgatttcactgatagtaaatttcattaaataaaatgtgatgctttatcttgagtttttatacaagtaatactttttaaaataaaaattatctccccaaatacaaaaatatatagaataaaaaataacatcagtccctttataataatttaatttttaattgtttgcccttgtactgttttgccactgtaatatatccttggaaaaaaagttttttagggaacgagaagtggtagaaatgaaggttttcctaccttaaagaaaagcctcactcttaaaccaagaatggtttagcctcagttttggtgagcttttcagttgtattcttgatatataattttttggtgaatagattccttctcttactccaaaacagactttatgtattggataccaagtaaatagtaggtttaagtaaaaaaagaaaagagacaatgtttttggcataccagaataagtctaatatattggtctctgttctgttacctgtaatttagggtaagacattgaaagaattggcccaaggcaatatgtagtctctgatccaagaattattcttaaaacttatttttttttccccagaggagaagccaaaaccagatccagtgttaaagtctccttccccagtccttaggctagtcctcagtggagagaagaaagaacaagaaggccagacatctgaaactactgcaatagtatccatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcacatcttgcacagaaacatcagaccctttaccaacaaatgaaaatgatgatgatatatgcaagaaaccctgtagtgtagcacctaatgatattccactggtttctagtactaacctaattaatgaaataaatggagttagcgaaaaattatcagccacggagagcattgtggaaatagtaaaacaggaagtattgccattgactcttgaattggagattctcgaaaatcccccagaagaaatgaaactggagtgtatcccagctcccatcaccccttccacagttccttcctttcctccaactcctccaactcctccagcttctcctcctcacactccagtcattgttcctgctgctgccactactgttagttctccgagtgctgccatcacagtccagagagtcctagaggaggacgagagcataagaacttgccttagtgaagatgcaaaagagattcagaacaaaatagaggtagaagcagatgggcaaacagaagagattttggattctcaaaacttaaattcaagaaggagccctgtcccaggtaagccattctgccattaatctcgtgcttgctgaacatgaagaagaggcagtgtttgagttattttttaattggctactttccttgacttccagaaacatcgaatgaatgctgaaattcctagtctggtttcttcagtggtgtgtttgtgttttagtacaacctgcaaaagagttactccattgtctaaaaatgcaaatgagaatttccaaatatacaaaatgcctccaaggtatatgtcacgaaacatgttgggttttgttgttgttgttgttgctattgcctcattcatatgaattggtttctcaatgcttaattttgctgctttggggctagaaaacaaaaaaccaggatggtctatagtccctaattctgtcttcctagaattttaaaacccagtcaatcctaaaggaactcttctatgcatgaccagtttttaaatcttggatgtaggaagatagcaatcagaacatcaaaggtttataactatttttgaaaatataatgctgttgttgattcacttgcaggtaagcttaacgttctctcactttgccttttgaaacagttttattttttgtgtacatttttacatggtcattaatatccttggagtattatattcttcccagttcaaattatttctttttaatgtagcatcacctgggaccttaggaactaaccattgggttattgtaagtttaatcaaaagttatctgaggcttatcagctattctaggataagttagcccataggaatattgaagttttggctttgaacaattcagcacagcctatcttctgcaacattgccctatgctatataatttcctttctctgtgcctgtcagattaagtaatgcgtatgtaaattgggctttttgataaatgagtgctcctccagcagttgatccttgacatgcagtgaataggttttggtcaccatcatcctcagtatttttgtctattttgaggtgtataataaggaaatttgacaaacccaaaagctgatccctacttttgagatgtggcttttctacccagctcagttcttgagacaatttcctcatcagtgtctgtaagaggtgtctggccttttggaactgcagaacatcttgtagaacaccatgagccagcacaggaaagaaaacaatgcaaggcaattggaacagtgagaaatttttcataaatctttgtaaattacctgtttcctcaactatctggcttccattgacatcagtattcatagtgccatcactgttttaggaaacttgttccttggtggagagatgaccttagaccttgttttgtcagttaccctttagaaaaacagccttggggccgggtgcagtggctcatgcctgtaatccctgcactttgggaggccgaggtaggtggattgcctgagctcaggagttcgagaccagccttggcaacacagtgaaaccccatctccactgacatacaaaaaaaatagccaggcatggcagtgtgggcctgtagtcccagctactcgggaggctgaggcaggagaattgcttgaacctgggaggcagaggttgcagtgagccaagatcgtgccgccacactccagcctgggcaacagatcgagactccatctcaaaaaaaaaaaaaaaaaaaaaaaaactaaacaacttggtgttggtgtggctgtaggtaaatgccctccgaagaaacacgtgtttgttggagaacagtaatttgtttgacacttcaatgttcattttcatttgtagtgatacgatagttacaaaaatgagagaaactaatgaacaaaaatgtttttaaaatgtaaaagcaaagaaaaacaaaacaatcataggaaatataagttgaagatacaaaccatacctcagaattgaaataagtgtaaagtgaaaagaccatgcatcaaaatcatacttcactcatttctgacatatattctttttttaaacatcagtttgccacttagatgacctgatattgcaagacagtgcccagggatggatgggcaaacagaattttggtttaaataatgttcataccatggtacatttgtttgaaatgcagatgctctcaatattagtattgtgaacaccagcaccttaatcaaagagtatagactcttcagtggtaatccagagagcacttagaaaagaaagaactgtttttttaatgacttggaataacagaggtttgtgatgttgggaggtaaagtttcttggcatttttctagtctcctgattttttaacctatgtgtttaagggaattacaagttttataatttccttgtacatcttaatagtcttcaaaatccaacagtaaatgaacttcaagaacccctgcaactctagctttttttttttttttttttaattttttttaagatggagtctcgctccatcgcccgggctggagtgcagtggtgcaatctcggctcactgcaacctctggctcccaggttcaagcaattctcctgcctcagcctcctgagtagctgggattataggcgtgtgccaccacgcctggcttatttttgtatttttagtagagacggggtttcaccttgttggtcaggctggtctcgaactactgaccttgtgatccgcccgcctcagcctcccaaagtgctgggattacaggcatgagccaccacacctggccagcagtttgtaaattataaagcctcagaagcatttctgacccattcatttctgtccgaatattttttaatggttttgtcacaaaagttaacaatgaaaattaaaattacctccagtctttaagtatatccacctgacgtggtcatatgcttaatgactataatttatttgcacttattcacataatattcacttattataccttgtttactttgagaagttagtaaatcataacagccgtttactttgagaagttaataaattgtaacaccaaaacagtctggtttgcctatgagtcttttggtggtgacttttgagaatagtttttacttgtctctgcctgaggatgaaacacctcaaagctggcttcagaaacctgatacataaataacatatcagttggtatagagatagttggttaaagcagtaaagttataacataagggatatggtatcttttagttctgctgcaaaacattttcttgtaactattctagatcatatttctgagtgaataaaaatgcatcagttgaggccgggcgcggtggctcatgcctgtaatcccagcactttgggaggctgaggagggtggatcacctgaggtcacgagtttgggaccagcctggccaacatggtgaaaccccgtatctactaaaaatacaaaaattacccaggagtggtgatgcgcctgtaatcccagctattctggaggctgaggtgggagaattgcttgaacttgggagatggaggctgcagtgatccaacatcgcgccacttcactccagcctaggcaactgagcaagaccccatcttaaaaaaaaaaagaaagcatcagttgttttcggattgaagaacaagctctgtaaaattagaatttggtgtgtatatatcttcagtgtactctgaaaagcctcagttattggccacacttttaatatcaccgtcactttagtaattaaatgcataaaactagatattaattggatgatatattaaagtcttgggaatttttattgtttattctctgtatctggtgggaggaaaaaggagtgttttgaacttgtgggaaagcattccccattaatcatccaggagtttgttttctacaattttaggaatgtatatgatgtatagtatgtaacattaactttcccactttttaaaagaattgtgacttttttattttattatttttacctgtatcagatataaaaccattatttaaattttcttaggcagagggagatttctaatttttctatttattttgtttttttggctcttgcttatagtacatttttaatgtatattttgtaagtttgttttatgaacttatccagataaattttcctggatgtagattgatggcaagttattctaaagcagatttgtgtttactttatctgctgcatgtcttggggaaagcatttgctggaactaaatctgggtttaatgtttgttagaactaaatctgggtttaatgtcctaaagctacagttctatcccaaagcctaaggacagccataccgtatggcttggatactaattttcagggtaacagcaatcttctctccatccagttgaaacaacgtcctttctcatcatcactgtgttggttcagtggtttattccctctctctcttttttaagctatcttttcactgagcatgtcacccatttgggagtctcagagctttatgtgagcatctcagttccaggttcccactttgcagggatccaagatctctcttttcttatgggtgttaaaaatacaaattcattggttatagagactggcacacccttctacacccccaggaatgtaaggatggcatcagccactgacctgtagtttaccttatattctcgtaagctcagctaaggatgtagaagggtttccagattctgtagaatataacataggaagtttatttctcaaatggagatacgattatatgttttggtaatgttaacaaaatactgatccatgtagccaatcaagttgctgctttctcttttagtttagacttactgaagtgtaaagggagcatacttcagtgcaagaaaaatattttaataacaacccttgctttattctcaactgtgagagtattcagagtactttcaaagaaataaacatagcaaacataaaaccagagatataaaagtctatcagttttcctagattaaactaaaaatgactaatcttttaaataataaaatttattctaacctttgctcaacttacatattctaaaatatatttgaaatatctctggaagatttagtcgctggggccaaaagtagattgccaatggtttgagtatcctgttggcctaatcactatactactatgcatccttataatttagcttctacagaaacgtgttctggaaacatggaaacaggactccttacacattcctggttctttgtcatctaccaaaacaagcagagtgatccttaaagcaaggaccattggcttcagttttcagaggcttgagtctgagtgatccttagggataaataaaggttttctccaccttgtttgtaaactgtttccaacaaagctgcctaaaaggtatgtttctgccatcccattcctattttcttgtttccctccccagtaaactcttaggcattccttggaaaatactgatgctggtcaaattcttttatatactgcagaatgagcccagacacctgttagttgagcctgttggcaagtcccttacgtagttcttccttgcctctttatgtgggatagatttccccattttttacagtagttcatgtctttcatcatgagccctaaagtctcagtcattgggtattaacttagttctacatctttctgagtagttatactttgttcaaaatgtagctcccttttccccacatttagtaactaatcctcctccatgacaaaggactattgtactgacctgcttccagagaaggtaattcagtcagcctagagctgtgctccctcagtcttttaaagaaaacctctacaggaaaacctagtcttactataagttttccctttctctaatatccatcattaccttgcacacagttgccttgagaacttttcctgattgccttggaaaagataactttccatgttcctaacacaaagaaatgataaacacttgaggtgatggataccccaataaccctgatttggtcattacacattatgtgcttttatcaaaatatcacatgtaccccacaaatacgtatgactattatgtatccttaaaaatttagaattaaaaaataaaagcacaagtatgccaaaataaggaagataagtttagtaagactttattaagaaaaaagataattctctctactaatgcataaaaatgcccaaaatacatttccttcaatatatttcttttcttcattttctattactgtattaaaatacttggtaatttagtcacaatcataataaaaattattgtacatttttctgtttccaaaggctttcccaggcatttcaagcattattcttgtgatttgaacagttattcctggatatagttatttctgttttgctgatgacaaaaataagcctcagaatggtaaatcagctttctcaggctcacaggagaattacagccccttcctttatacgtcatgtttctattaatctttcagagatggtatgtcaatacaaaattacctcaggatttgacagttatactttatgcttgtgacctaggttcatagtgaaacatgaaagcccacctgtttgaaccacagtagttactgaaggcctactgcgtgtcagtcattgttccatgcacttgagatttatgaatgagtaatacaaagatccctgccctagtgatgtattaggaagttttaagtgctgtaaaaataataaaacagggtgaggaatgcaaaggggcagcaggttgtagtatttaaataatatgatcagagtcataggcctcagtaggaggtaagatttgagcaaagacgagggggattatttgagctaccctgtacaaaatctgtgattttcctctttttccttttgaaaaacatacctatcaaaacccttgaatcagtactataactcctactttgtctattaaactccagtaggcagagcactactggagaagatcacaccacttacagtggtgtgaatgcaactacaaattcacactgtccatcccaaccattatttttatggtttttctgttgaaaatcctttactctgcccagtgctactcacctgcagcacatgacctcgtctccttctttattgagaacattgaggacactgggtacgccttttttttaactttctgcccccttacaaacctggctatattgaaaccttcatcagactctcttagttgtctcttacagtctcgtatgtattcactgcctctctaccaccttcttattgtctgtctcatgccagagacgctctctgagtcccatataaccatttagctgccacttaaatggtatctttttcttctgacccaaactgtttaagaatagtctaccatgtcttctactattcttttcactattcaactaacatatagtctgatttatgctcctaatatgctagtggaatcttcctcagcagggtcatcagtagacacacatttatcttcctagtctttttgcctcattttaccactattggtctctttctctctctcttttaagttaggtcgagtgtaatttatatgcagtaaaattcacccttgttagctagcattcatttctgtgagttttgactagcacagaaagccatgtaatcacaccagtcaaaatataaaacagttccatcagctgggcgtagtggctcatgcctgtaatccccacattttgggaggccaaagtaggatttccaaatttttatctctgtcccaactcctcctctaaacttcaatcttaaatttccaattatctgacaaatatctccacttgcagagtcatctcaaattcagtacatccaatactaaaccagtcacctattcctctaaacctattctttcatctcaggttatacactggctttaattaaactaaaaccctgaagccactgttgacgaacctcccttttgagtccccttttttcccatccagtcatttcacaaggtgccctgtttttgtttttgtttttccccccacaagatagagtctcactctgttgcccaggctggagtgcggtggtgtgatctcagctcactgcaaccttccgcctcccaggttcaagtgattctcctccctcagccccctgagtagctgggattacaggtgcgcaccaccacgcccggataatttttgtatttttagtagagacaggatttcaccatgtttgtcaggctgatctcaaactcctgaccttgtgatccacccggctcagcctcccaaagtgctgggattacaggtgtgagccaccacgcctggccggtgccctggttttatctaatgtatttgtgacatttgttccctcctctccatttccttcttcccctgccttatccctgcacttaggtgtggatgcttgtcatttccttggtcccagttttgcccccacttgaaattgttctccaccaagtggccgaaatcatcttttaaaaatacagatctagctttgtcactcctctttcacgtctttttaagctcttcaggatgctgtgaaggattgggggaaatatcctgcaagatgaactctaaacttctcaagttttaccaccaggtcttctggtatccatatcctctcatacctctgcatcgtcagctacagtaatccaccagtgttctagaagcctggagattatttcaaaagcgccatatagtaggagtcttctgagtatacgggcatacctcattttattgcacttctctttattgtgctttcactgatacggttttttttacaaattgaaggtttgtggtaactctgtgttgagaaagcctgttaatgccattttccaacagcatgtgctcacttcctgtctctgtcacattttgataattctcacagtatttcagacctttcattattataggtgttatagtgatctgtgatcagtgatctttgatgttactgttgtaattgttttggggcaccacaaaccatgtaagacggccaacttgatcgagaaatatgtatgttctgactgctccaccaaccggcagttcttccatctctctccctccctcttcttgggccttcttatttcctgagatacaacaatattgaaattagggtattaataaccctgcagtgacttctaagtgttcaagtgaaaggaagagtcatacgtctcccgcttgaaattaaaagctagaaatgattaagcttagtgaggaatatgtatcgaaagctgagacagagtgaaagctaggccccttgagacagtaaagttgtgaatgcaaaggaaaagttcttgaaggaagtttaaagtgctactccagtgatcacacaaatgatacaaaagcaaaacagcctttttgctgacatggagaaagtttcagtggtctggatagatcaaaccagccacaacattcccttaagtcaaagcctcatccaaaacagtgccctaagtctcttcagttctgtgaagactgagtgaggtgaggaagctgcagaagaaaagtttgaagctagcagagcttggctcatgagattgaggaaagatgtcatcataacgtaaaagtgcaaggtagaagcagcaagtggtgatagagaagccacaggaagttatccagatgatctagctaagataattgatgatagtggctaccctaaattacacattttcaatatttgttgaaaaccaacagatactgatattgtagatgaaaccgccttatgttagaagaaaccatctacctactttctttttttttttttaagacagagtcttgctctgtctccagcctggagtgcagtggcaccatcttggctcactgcaacctccgcctcccgggttcaagcgattcttctgcctcagcctcctgagtagctggaactacagatgtgcatcaccacacccagctaatttttgtatttttagtagagacagggtttcaccatgttggccaggatggtctcaatctcttgaccgcatgatctgcccaccttggcctcccaaaatgctgggattataggagtgagccactgcgcctggccccatccagcactttcacagtgaaagagaaggggagaagtcaatacctggcattaaagctacaaaagacaggctgactctcattaggggcttatgcagccggtgacttctgtttgaagccagtgctcatttaccatatggaaagtcctaaggcccttaagaattctgctaaatctattcttcctatgctctataaatggagccacaaagcctggatgatgacacatctgtttgcagtgtggcttaccgactcttataagcctactgtagagacctactgcccagatagcaagattcctttcaaaatactactgcacattggcaacacacctagtaacctgagatcaaagagtaattttgactttcaagccttgttatttaataagtacattttgtatgtctatagctgccatagatagtgattcctgtgatggatctgggcaaactaaaaacctcctggaaatctgatttgttcgtggcatttgttccttcctcttcatttccttcttctgccttagttagccctgcacttatgtgtggatgcttgtcatttccctggctccagttttgcccctacttcaaatttattctccaccaaatagccaaaataatttcagcattctagatgccattaaaaacatttgtgggtgcagtggcgcacgcctgtagtcccagctactcaagaggctgaagtgggatgatcatttgagctcagaacttcaaagttcatctgcacaaaagaggagacacctcagcaagattcctgtctcttaaaaaaaaaattgtaattcatgggacaaggaggttaatatatcaacattaataagcatttggaagaagttgattctaaccttcatggacaactttgaggggctcaagacttcagtagaagaagtaagtgcagatgtgatggaaatagcaaaataactagaattagaagtggagcctggctaggcatggtggcatgtgcctataatctcagcatttgggaggctgaggcaggaggattgcttgaggccaggagcttgagactagcctgggcaacatagtgagaccccatctctaagaaaacaaaaacatagaactaaagcctgaaaatgtgactcagttactgcaatctcatgataaaacttgaatggataaggagttgcttcttcatgggtaagcaaagaaaatggtttcttgagttggaatctattcctgttgaggatactgtgaacattatagacatgacaacaaaggatttagaatgttacataaacttagttgataaaacagcggaagggtatgagaggattgggtaaaatgctatcaaatagtatcacatgatacagagaaatcattcatgaaaggagcagtcaagtgttggagcaaacttcattgttgtcttattttaagaaattgccacagccactctcatgcctcagcaaccaccatcctgatgagggcagcagccatcatcatcaaggtaagaacctccaccaacaaaaagattacaccttgctgagggctgagatgatcattagtattttttagcaataaagtattatttaattcagataatatgcattatttttagacataatgctatttcacacttaatagactacagtttagtagaaacataacttttatacgcactgggaaaccaaaaatttgtgactcgctttattgcaatattaacttcattgccatgatctggaaacaaacccacaatatcttcaaagtatgcctgtgcctacacaggcataggatctgaatgtagtttttcatgtatttgattaaacactggcagtaaaatttagtggtaagatcaaagcaacagcatcaaacactcctgagtcttaccctttttccttgtctatctctgtgaccatgggtgaatttcctaacctctttgagtctgtttctcatctagaaaaatgaagataataatagtatttacattatagaattgtaaagataaaatgtgatgtatgtaaagtacttagcacaacatctgacacatattaagcactctgaatgttaaataatattgataattctattttcagcttgtattaagagcccaaatgttccctttgaactctgctaatacacagaagagttggatatcatgatctttgccctgaggaatttatcttccaaagaaaggaagctcaaggagttgataccttctgaaatgtttttaataaaatctgggacatgagatggtggaaaatcccttaggataggccgtttgcatgtataatgttgattaaaagtttttgtacccattatgtcatttatcttcacagtagacacatctcaaggtgacctctgctgtgattggtaaaggagaaggcctccttagaacagtgaaggaaaatctgtagttgagttgaggatggtaataccatcattaacttcctgctttggcaggagtggaaaattaggaagaaaggcaaagaaagctcagaagaatgggggggaaaatgaatagggcagccataaagtggtaacaacccaaatcagtttatcaactgatgcatgaataaacaaaatgtgatatatacataccatgaaatatcggaccatgataaggaatgaaattcacatggtgtacaatggatgaaccttaaaaacattacgctaagtgaaaaaagtcacaaaagaccacattttatatgattccatttgtatgaaatgtcaggaataggcaaatccatagaagcagaaaataaattagtgctcaccaggggttggggagagaagagagtggggagacggtgctaatacataccgagcttctttctggggtgatgaaaatattctaaagttatatagtggtagtggtcacacaactgtggttataccacagaccattaaattgtatagttttaaaaggttaattttatgatacgtaaattatatgtcaacaaatattacatatatattttaaaaagaggggcctggcgtggtggctcacatctgtaatcccagcactttgggaggccgaggggcggatcacgaggtcaggagatcaagaccatcctggccaacatggtgaaacctgtctctactaaaaatagaaaaaaatagccaggcatggtggtgcacgcctatagtcccagctactcaggaggctgagacaggagaatctcttgaactcggaaggcggaggttgcagtgagccgagatcacaccactgcactccagcttggacaacagagtgagactgtctcaaataaaagaaaaatgagtatgatatggtggtgccaccagcatctatataaggatttgcttagggaagttatagcttagaaattgaggaagtaaatttcaacaagaacaccacaattgacagtatcggagatacaggagtatttgtgtacagccaaaaattatatcatcttttgacacatgctattgttgtataaataaatttatacaacaattacttatatagtgtatacataaaaactgtattgtttttattctgtcttattactttactactagttaaattttacctcagtttgagagggtgttctcagcttggtattgaatgtaccacctgtagagttcaagaccagcctgggcaacatatggagacctttcgtccctacaaaaaaataaaaaattagccaagcatggtggtgtgtgcttgtagtcccagctactctggagactgagatgggaggattgcttgagcctttgagattgaggccgcactgagccatgttcacaccactgctctccagcctgggtgacagagtaagaccctgtcaaaaaaacaaaacaaaaaacacctgtagcaatcattctagaggcattgctcgatgtcacagatatgaaatatccagttgggccggcaaagcagagtggttcttcatgatcagaacataagggatctgtgttttggaagtagtgattctgctgtttctttgtttgtaacttggtcccttatgtttttggcccagttcagccaccctctgtaactcttccttcaactctcctacctgagacccttctggatctgtctcttctttccagctatctaaccattcatttattcacccatctgttcaatccccatttcttttcactccatttcacagactgtcattatcttacacctcagctattacaactctgctttcagacttctctggaaaagtaaagtgcacattttccagaaaattctttcagagaaaatattgctgctggatgccagatatctgtctaagacctgtagaaatagtcgtttcaagggtacaagatccaggctcccagattagccttgaaactatcattatttcatcctagctttgcttaatattattttttaatctttttgcaaatctcccacacctgtttgatgagtgttaattcctgcattgtttccttgatgctgtcttcaacctagaccacattaaggaacctgctcaattcagttagctgggtgtggtgcctggcacctgtaatcccagctactcaggaggctgaggcaggagaattgcttgaacccaggaggcggatgttgcagtcagccgcaattgcaccagtgcactccagcctgggcaacagtgagactccacctcaaaaaaaaaaaaaaaaagtatttttttcaatttttcaatatgactctattcacaaggttttctattctgataattcctcgaacccttaaacatataattatgtcaatttaaaatactcgtagtactttatgcatattgatatgtgtacattttacctctccaacttcttttacatctccaggattagtaaagcttttatttttctgttatccccgagagcttttattaaatgtttatttactcatttctgcaaatgtatagatttgtgttgtttttgttgggtttttgttttgtcttgttttttagggatctgatagtaacaaatcaggtatatttaaaatcaccaccctggtaagaaaaaattgtagtttttttttttttttcttttcttttttctgagacagggtcttgctctgtcacccagactagagtgcagtggcataaacatggctcactgcagagttgacctcctggtctcagtcttcccacctcagccacctgagtagctggaaccacagatgcgtgacaccacacccagctaactttttgtagagatagagtctcgccatattgcccagctggtctttaactcctggcctcaagcagtcctcctgccttggccttccaaagtgctggggttacaggcatgagctaccatgcctggcctgttgattttaataatagtagctatcattgattaaatgcttgctatttattagacactgtggtcagttctttaaccctcacaacaactcttatccttactttacagaagaggagaatgaggcatggaggagatgatacttgctgaaggttatatagttaataagtggtagaatcagaattcaaatttcaactctacaatttatactcatagccacgtctttataatattgcctctcaaattaagctacatatcctgtaaataaatcttagacttcagcattcaaaagttaaaatcatttaaaatagttcttactaaaataagatatttttatatgaaagatgaatatatacataaagctacagctggataaacaggtagatgataacaagggatacaaagtcaaatgtgctcaccctgaataattaggaaaagcaaaaagcacagaatgtatctttcccagttcattagttaatacctctctccaagtttctgccaattccagaattcatgcatgtaacctcggaatcaccttaatacttaatgcagtgtttaagaaataaaagtaggctggctgctgtggctcacacgtataatcccagcactttgcaaggctgaggtgagaagatcacttgaggcccagagttcatgatcagccttggcaacagagagaccctttctctacaaaaaatttaaacattagccaggcttggtggcgcatgcctgtagtcgcagatactcaggaatctgggacagaaagattgcttgagcccaggagttcgaggctgcagtgaggtatgatggtgtcaccacactccaacttgggcagcatagcaagaccctgttgctaaaacgtatagaaataaaaatagaagtcattatttatgtgatagcattcaatgagatgattaatagcatccaaaaactattagggcttttgtaacataataccgttattaatagttgtcattcattcaacaggtatttattgagtcccagactgtcataatttatattagtttttaacagaattcaaataagatttgagtgatatttgaaatatttaaatcagtatacctgatcatgtagggaaaacctccctttgacatgatattatacactgatgttccataaattgtataaatcatgaataacccctaaaacatggcttttctgtatatcttacaaatgagttttactctaattttaaagccataccaaggtgtaaaacagtacgtatagtataaataaaggagaaacctgtatgcacattcacatgtataatgcacacatatatgtgcttgcatatacaccagtattttctgaggataagtaggaaatacttaataatgattttctctggggagagagacctaagagcaagatggggaagacaagactttttcagtttttcctcgtttgttgtgaaatctttttgttcatatgaattacttttgtcataattaaagccagaagcaagtttaattataaattttgcagtaatatgtgtcttaggtctcattcaaataataattttcgggtgggtgaggtggttcacacctgtaatcccagcactttgggaggccaaggtgggcagatcacctgaggtcaggagttcgagaccagcctggccaacatggtgaaaccccatctctactaaaaatatagaagttagccaggtgtggtagtgcacgtagttccagctacgcgggagactaaggcaggagaattgcttgaactggggaggctgagttggcagtaagccgacatcgtgccactgcatgcactccagcctgggcgaccagagtgagactccatctcaaaaaacaaaacaaaaagaacaattctctcatgatttatctgatatatgtgaaacatagattgtcaaatttcgaaaggtacctaccagtctgttttgaatgatttctaatattcctcaagatttgcagtgcctcacttcttattaatatcagttattcttcagtaatataaatgcggagaacagaaatatttcttaagaatttattttttgtatttctgataccatttgtatcatgatgttttcattagagtgcagaaaaattccagtttttttggatataagatttagtattcagttcaacaaacatatcagcagataaagttggaataaatagatgctgacagttctttaaatttcaataacagactctagatcttctctaaaatgtcatgttaaaatgagttataaattagaatacccttttgactgcctattctccatattttgggacacattagagaagatattcaaactggaaactgtcatggaaaaccaagaaatatgaatgacttaaccatgagtttttatgatgtgccaaaagagatgtgataaatccatgcttcactatgtttggtacaaaatccagaattaaattggttaatagattgatttcatttgttctggcaatgctaatttatatctaccatgtgacaggcccttttctgacctctagcaccacagagatgaatgaggcaaagtctttttccactgagaacttgataattttgtagagagacagataaatatatatatatatatatatatatagggatgggtaaggtgaagagaggagggaggaagtgatggtccctgttagagtgtattttttattattcatagtagctcccacatattaaggttaaagcaaatttctctgtgctttgcagtctggtaatgtagactcactgatggtcagatggaaagtagattttttttttccatctagagttatatattcgaggcagtgagctgtagcattttatttggagatgaaaagtgttgagtaggtgtaagggtaactgtattatagtctctttcctaattaaattacatatttgtgctgtagtgattgacttttttgcatctgtactagatttaccttgaattaaattgcagtcttttttgatgatggtagaagtggttcaaaagtgtcttattaaaatgcaaaagtgcctaaaacacagagcagtaaaaacagaggcctagaagatatgccagtggtctcattggagtcatctttgttctcagtgtcgacaattgcttaatggactgtcctccactgaactttttggagcaaacctacttagtgtcactttgccattttatttttttaatgacatactgtgctgttggggcaacaaactgcacatcctgtcatgctacaaaagcaaaagacaactttaaccaagataaaaatgaagctggaattcaggcaagaaagtgaaggataaggcagacttgagaggtggggtattgagtggggaagcgttttgaagttagatctgtgtttcagttctagccccaacctttactctctgtaaaggggaaacttataatctctctgttcttcagtttcctcatctctgaaatgggaatactgtaatactacctacacaaagagatttaaccagtattgttgttctagagagacattaaccttgggtttaattttgattgcaggtcatttattcattaacagatttgccaggcactgtattggttgctgggtagattgaagagaccaacaaaatacaatccttatcctcaaagaactcaaaccctaataattattcttagcttgtatccaagtctttgattgtgtagagtagcaagggtgcacactaagtgggttggtaaaaatgttgaaactgtagagcagtaaatgggcctgatgttgaccaaaaggtaaaagccagatttctaactttgctgtgtatcagaaaccagagaagcacatgttcttaaataggtagaccttgaatgctggacgtggtggctcatgcctgtaatcccagtactttgggaggcccaggcgggcggattatctgaggttgggagtttgagaccagcctgaccaacatggagaaaccccatctctactaaaaatacaaaatcaaccgggcgtggtggtgcatgcctgtaatcccagctacttgggaggctgaggcaggagaatcgcatgaacccgggaggcagaggtggcggagatcacgccactgtactccagcctgggcaacaagagcaaaactccttttcaaaaaaaaaagagatagactttgaagctagtagtagaatcattctcatgcaagtgaatttacgtcaaaatttttggatttaagtggcactttgataagtatttgagataccaaaaattagagttcagtcaagagaaattgatgtttgaaacaagatagagaggtcttcagattctaagaagttatgttcgatatggaaataggaaaagcaggacttggagactgatacgaatataggcctaagagaacttttcaaaaagagtttgtatcagacaataccaataccaaatgctgcaaaaatacttgagtgtaatggtgaattgaaaggatgttgaatttgtgataattttgtcatttactactctgagacaaattccatcacctaagcagatataagcaccaaagatttggagaaagaatagtgaaatcaagaaaataaagatacaggtatgtccatggcagggcagaagcctggggatgtcaaaatacacactggacctgctgaagcatgatgagaaaagcagaagcaggtgcacgttttcttctactttccatgccactttggaaaagagtccaaacatttagctaagcgggggcttttaggctgcatacttaagtaagcattatctcctcacctggcaatatcagaagctggagtataatgacaaaaaattgaattcaacagtattcttccagtttagcatatatggctgtggaatcaccagctcagatcttggtataatttgagggtctggtatctagtccctggtacagatgtctcacattgcaatcctgtgacataatccatgaccttaaaatcatggtttggaatccaacagctgttctttcggaatggtcaaggactgaggtcagtttatataatgaggcacactgttggttaagctgatacaccgcttcaacactgcattcagattaatggtttctattgagccacttcttttctctttgcctaaccttgcatcaatagcacaattaccttcgttactttagttttataatatcctaatattacaagcccactacctttaaattctacatcaaaattgtattggcttttcttggcttttgctttttcatttccaaataacaacatatggaattgttctctgcacaaaataggtatttgatcaacggaaaaattagaagattttttttctttatgcatatggtatatttagggtttcatatagattaacaattttcttataaatgtttacatcacataattcttagaattttcaaacacacccaaatataatttatacataatttttataaacagttctattatataaaataattattgctgttcaaatgagtcagttatgttgtttggaggagcaacagagaggcagacttactaaaatatattttagcagaaaaggttttgaaaataatattgggactttagctttctctataaatggatggttcctgcatttactatcaggaaacctgggccactgccattctgaaacagtatttctagagagtgaccaaagagagttggtgtaaaaatcctaaaggcccagaactgaggttaatggggaaaaaaaacccaagctctcggtggaagttttggtcagaataggagatgaaacagagtacagtgagaatcaggtagcttctgatcagtaagaaagtctaccatatatgttactggaatttttaagcctctttctcttagaattctctcagttcctattacatggtagattaatcgaagaaagtcattctgacttcctgttcttggcagtaggaatcacctttctcacttaaaagcagagaacaagcctaatatattctattattctattctctcttctatccaaccaccagtcataatgtgataataattttcagttttagttgttgccctttctacttacttttgtgccataatgatgccttattaataggctatctcatatctttactaataaaaaagaatgtgaataaaatatattaaatcaaagtttgcttgaaaatttacaggaatttgtctacttgaaatatgtgatttaaaacataaattgcctattttaaaaacttagttaaatgtcactatcaattttatttgtacaataaaatatctcgaccggacgcagtgactcacgcctgtaatcccagcactttgggaggtcgaggcgggcagatcacctgaggttgggagtttgagaccagcctgaccaacatggagaaaccctgtctctacaaaaaatacaaaattagctgggtgtggtggtgtgtgcctgtaatcccagctacttgggaggcttaggcaggagaatcacttgaacccgggaggtggaggttgtagtgagcccagattgcgccattgcactccagcctgggcaacgagcaaaactccgtcttaaaaaaaaaaaagaattatctccagagggctaactgaagtcatcacaagagaaaataacattctgactttggtgtctttagaaggatagcctacatcattacaacattctgattttcttctctataaaagggtctctaaaaaatagtattgcttcgtgattctcaaaattcatagctagagtaaaatagctgaggagaaacatgccagatcataggctttgtagacgctgtgtctcccttctaatttactttatgatatatattaaaggcaagagaaaaaagacttttccttgccttaatttcagattagttaaaatggatattttctttgattattttttcttttggtattgttttcaaagttagcatatattgattagagaaaattcaatataaactgatgatgataagaaaaatatggggtcaggcttggtggctcacacctgtaatcccatcactacgggaggtcaagttgggtggattggttgagcccagtagttcaagaccagcctgaacaatataacgaaatcctgtctctacaatacaaaaattagccaggtgtggtggcatgcacctgtacttccagctatacgggaggctgaggtgggaggatcacctgaaccagggaagttgaagctgcagtctgccgtgattgagccactgttcttcagcctgggcgactaagtgagaccctgtctaaaagaaaagaataaataaatgttgggttttgtcttggcagaaaggaaatcaaaagacaatatgtataagtttaacctgtctgtaggaaaatacctgtcggttaaaaagaaaacaaagcatctaataaaagattggataaaggatgagaataggaaattcacagaaaagaaagaacaaataaccaaaaacaaaaaaaggaaaaaatgcttaacctcattagtgagtgtagaaatagcccatttaagctattagtttgccaaatataaagtacttgtgagaatggagaaaatccaacacacatttatttgtgagaggagtatgagtaacctttgtggaaccaaatctgacaatatctatatttggaaataaaattactagtataggctgggtgcagtggctcagacctataatctcagctgctcaggaggctgaggcagaggattacttgagcccaggagttgaagaccagcctgggcaacatagtgagaacctgcctctttaaaaaaaaaaaaaaaaaaaaaaaaagatactaggaggatatatttaaaagttttcgtggtaagaaaaatagcaaaaacgtaagatttttcaaaagaaatgttgcatactagtatttgcataatgactacatgctaggagggattttaagtgaaaataaagcatgttgaagaataactcatatagttatgaccccatttttctgtttaagataaacttgtggctaggtgctgtggctcatgcctgtaattccagcactttgggaggctatgacggaaggattgcttgaggccaggagttcgagaccagcctaggcaacatagggagacccatctgtacaaaaaaacaaaaattagcaaagtgtgctggtgcgtgactgtggtcccagctactcaagaggccaaagcaggaggactgcttgaacccggtaattcaagagtgtagtgagccgtgactgcgccagtgcactccagcctgagccacagagagataccctgtctaaaaaataaataataaacttgtatatagggttgtgattatttgtatgagccatgatggtgtagaagactatatatcagacacagagtgctgaggcaaggttcacctcaggcaagtagaaatggctagttgggagagaggaatattacctttgtttaagtggacacatttgtcattaaaaacaaaaagtaaaagataaaaggcaacagaaattaggaggaagaaaaaaagcccttggaatcccactacttagatgtacagattatatatttacctttgtaaacggaaaaataactatatataattttaaagccttgtaaaaacagtatgtcatagaaatgtttttatgtcagtaaacatacattatcgtattttgatagttgtgtaatagatatatggaaatgctaatattttaggtacttcagaaaccacccagaacacttcagtatttctattgaggtatagttgatgtaaggttaatgtacacataaaatatttgatcacttttaacaggaacatgctctatataaacgataactataatcgtatttatcacccaaaatttttcttatgcctgttttgtaaatccctccctcctgcactactaccctcatcttcatcgccaggcaagcactgatctgttttttgtcactacagattagtttgcattttagaaatcttacgtaaatgaaagcataaactgttttttgtctggcttctttctgagatagggtctcactctgttacctaggttggaatgcagtggcacgatcacagcccactgcagccttgacctcccaggttcaacacatcctcctgcctcagcctcccaagtagctgggacaacaggcatgcactacaatgtctggctaattttttgctgtttatttgttgttgtttgtagagaccgtttcgccatgttgcccaggctgatctcaaactctgggcttaagcaatccacctgccttggcctcccaaagtgatgggattaaaggcatgaaccaccatgcccagcctgactggcttctttcattcagcatgtttatatatgttgttgagtatgtaaagagctcatttttaaaaattgccgagtatggatttgccacaatttgtctgtttgttaacctattgatagacattttggctgtttccagtttggggctattacaaataaagttgctgtgagcacctatgtacaagtctttgtatggacataagctgtcatttttcttgggtgaatatgtatagatgaaatggcagggttatatataggtgtatattaatttttaagaaattgtaagtcattttccaaagtacatttgccattttatattcccaccagtaatgtctgaaaatttcaggctatcttgtttctgctaaatctcctttgtaccacttctataaatacgttgtgcatacataatgagagtcgattgaatggattctctatttttttcaattgatccggttgtcttttcttgttgctcataccacacggtcgtgataaagaagctttgtaataagtcttaaaatccgagtattaagccctccaacttcattcttctttttcaaagttgttttggccattctaggtcctttgtttttctagattcattttataatcagtttttttctatattttttcctgcaaaaaaaagacagttgaaatttgatttgcattgacactgtagacagaattgacatcttgcaatattgagtcttctgacccatgaacatggtatattttgcttttgttttttgtttttgtttttgtttttttttttgagacagagtctctctctattgctcaggctggagtgcaatggcacgatctcggctcactgcaacctccgcctcccgggttcatgccattctcctgcctcagcctcccgagtagctgggactacaggtgtccaccaccacgcccgggctaattttttgtatttttagtagagatggggtttcaccgtgttagccgggatggtctcgatctcctgacctcgtgatccgcctgcctcggcctcccagaggcattttttaaagtattctttaattctctaaataatggtttggagtttctagtgtataggttttttgtatcttttgtcaaatttatatctttagatgcttgtgtacatggtattttttatttcaatttttgttactagtatatggaaatacaatatataatagatttttatatatcagtttcatgtcctgcaaccttgctaagtatacttcctagtcttgttagctgtttcatagagattcctttggatttttctatatggataatcatcttgtttgaacaaagacaaatttacttcatttccagctggatgcaccctttatttctcttgacttactgcactagctggaaccttcaatacaatgttgaatagaagtggtaaaagtaaacattgtcttgttctgatctcagggagaaatcattcaatcttttaccgttaagtatgatgttaactgtcagtttcttattatctagatgaggaatttcgtttttatttctagattgctgagaaattattttagtcaagaatataaattggattttatcaattgcttttcctacatttgttagtaaatcatatggttttttttgtttattaactgcttatttgaaaatatttgacatttgaatattaaaccaacctgcttccctgggataaaacttggccatcacattttttttctttttctgtattgttcaattttacttgctaaaattttatttagtgttttttttttcgggggcggagggtttgtatttaaatttataagggatgttcgcctgtagttttctggtgattgtcatgtttaggtatctgggtaacgacgcagacctcaaatgatgagttagtgagttttctccttcaatattctgggaaagttggtgtaaaattgatattgtttcttcctcaagtatttgcaaagaatccaaacagtctctaacagataaaaaagacaaggaaatagattcttccacagagcctccagaggagtcacagacctgatgatatcttcttgctttttggcccagtgacaccatgaaaacaatatgacccatgatgaggagaaaacaaatcgattgaaactcacaactgacatgcttagaattagcagacaaaatcattagagggttattagatacggttgctataactgtatttcacatattcaaaaagtagagataaggaatcgacataactggaaaacacagaattggtagaaccagtaaacagaaaactagtaaggacctaggagctggaatagcatagtcagccaacttgatttaattgactaaacattcaaacagtagatacacattcttttcaaatacaaattgaagatttaccaagatagaccatattgtggttccagaaacgaggcttaataactttaaaaggattcaagttggaaatcagtgagaaaaatatctctggaaaatcccccatatgtttagaaactaacacacttttaaataacgcagaggtcaaagaagaaatcagaaattataaaatattttgaaccgaatgaaaatgaaaacccacccattttctattttctattgctgttgtaatcaccacaaacataatggcttaaacaatacacattaattatcttacagttttggatgtcagaagtccaaaatgggtttcatttgggccaaaaatcaaggtgtcatcaggtctgtgactcctctggaggctctgtggaagagtctattcctttgtcttttttatctgttagagactgcttacattctttggctgtgtccccttcctccatcttcaaagccagcaacacagcatcttcaaatctctctgtgtttctcctacctccctcttttgcttgtaatgagcctttcgattacattggatccactgggttaatctaggataatagtctcctcatcacaagatcctttattatcacatttgtaaagtcagttttgccaggtagggctacgtattcacaaggttaaaagcattaagacattggcatctttggtgtggtccattattctgcctaccacactgctaaagcagtacatagatggaaatttacatcactaaccgcaactgttagaaaagaaaaaaaaaaaggcagggcgtggtggctcatgcctgtaatcccagcactttgggaggccgaggcgggcagatcacgaggtcaggagatcgagaccatcctggctaacacggtgaaaccccgtctctactaaaaatacaaaaaaaattatccaggcgtggcggcatgcgcctgtagtcccagctgctgaggaggctgaagcaggagaatggcgtgaacccgggaggcggagcttgcagtgagccgagatcgcaccactgcactccaggctgggtgacagagcaagactccgtctcaaaaaaaaaaaaaaaaaaaaaaaattctaataattgacctcaactttcatcttaagaaattattaaaagaagaacaaacacagaaaaagtagaagaaaggaaataatacagataggaaacaaatgtaacaaataacaagaaaacagggaaaaaatttataaaaccaaaaggtggttattgaggatataaataaaattactaaacctggatttgacttttactttgatatttaacatgaaagctagaagtaaaacaatttaaattgtgttatagatatctggcttcgttgtttttagagacaggttcttgctctgtcacacagggtggggtacagtaatacgatcatataaccatcaacccttgggctcaagcaatcctcctgcctcagcctcctaagcagctaggactaaagacacatgccaccacacccagctaattaaaaaaattttttttgtagagatggtgtctcactatgttgctcaggctagtcttggaactcctggcctcaagcaattcactcaccttgtcctccccaagtgaaatggctgtttttgatagaatttaagtctagtttcctcattttattatactgttttgtttctagtgctaggacctcaccaaactaactcatgtaattcaagctctttgtgaagtagtgatagagcagaaagattttgtcataccatgggaagcctaattaccaagtcaacatacatttcaaataacgacctctgagaagatgcggaaaaacactagacctaactctcaagtgtttcttttggttgccatctctcagtggcccatcattcttacatatttcatcgccattgttattcttttcaggtcattacatcttcattgtaaaatttatcctctcacctgggtttcttctttgtgccaccttagtttcttagataaatcatcatattttcctagattcccatgaagatctgtgaaaggaaaagaggtggtgatttgggacagaataggattcacagcctataggaactctagagggacaaagttcttgcatattatctaatcagaatgatttagtgccaacttgtagatctcaaaacttggaaaaaagtaaaaattgtcaaaatatatcaagaatggatgagaagggattaaaaccaggtgataaggatgggaactctcactgaaagttccattattagaacattctactttgtttatgcacaactctgtggcaatgcaccggggctgttccctgagcattagtgaagtgtctatagttggaaagtcttcgcagtctcagttttgtgtcacttcaatctaagagacccagactctggacacattaatttcaaaccttggaactagggagtttatgttgtattccaaaagcatgtggagctacaagggagacttttttgtaattcagagtctcttacttagccgttatgtggccacaagatcttcagctaatctgcacaattcaggcgcttcaggccaacccagaaaattatctccacaaatgtagaaaataaaacagctttattaattttttaaaaattttatcttgagaccaagtctcactctttcacccaggctaaagtgcagtggtgtgatcacagctcactgcagcctcaatgtcccaggcttgggcaatcttcttgcctcagcctcctgagtagcttggaccacaggtgcatgacactatacctggctaattttttaattattctgtagagatggggtctccctgtgttgcccaggctggtcttgaactcctaggctcaagcagtgctccaatcttgacctcatggtggcatgagccaccatacctggccttatttttttagagacagagcctcactctgtcatccaggctggagtgcagtatattttatttttattttatttttttaagtgacagagtctagctatctatatttatatttatataaggggtagaggaagtgtttgcaattaaccacaggtgttctttagctaaagatctaagaaaagggagagagaaaggaaataaaaggaaaataaagatctctttattataccaaggaaatagaaaaaatgttaaactcttacaacttacttggatgactacctgattaataaataagttagtaaagagaagcaatattaagtttatctaaaaattgctgtcagatttatattgttgcatagctaatagtaggatactctgggattaaagatttacctgtcttatgtagttagcgcttttacattcttttttttttttttttttttttttttttgaggcagggtctcagtctgttacccaggctagagtacagtggcacggtcatagctccctgcaactccaactcctgggctcaagtgatccacctactttagcctcctgagaagctgggatgacaagcttgtaccccgtgcctggctaattttttaattttttgtagaggtctcacttttttgcctaggctggtcttgaactcctggcctcaagcagtcttccctcctcagcctccaaaagtgttgggattacaggcatgagccactgctctcaacctcttttacattcttttaacctacgtggaatgatgctatttttggtttttcgttttttcgggtataaaatgagtactctctatgaactccgtaagttctccagatcctctggagatcagaatcatacacaaaattgtaatgtgcccagtaaaattaactgttttaagaatgtgttccaatagtatttttataaagagcaatctatcctacaatctataacaagactaaagtggattagtcatacaggataaaacagaatttgaaatagtgaatgaaaatcaactttaaaagttttacttttttatttctcccaatttaaaattatcattacaagcattgaagaacaaagagaaaccacttattgttcaagtatgtagcctgcatattagcgttaaacttttctttgtttccttccagtttttacataaatattttacatgattataaatgaagtgtaggtataattttgtgttttttacccttttctgttttttaaccttaacctactctctaaaaatcccatttagtctcattagcctgaatccaaatccttgctactagaagtggctcataaaaatctgtgctgtgatttgcctgttgacagtagatgtgaaacttgaccagtttaattttatccttatgtggattttctaaagataatcaagaaggtttttgttttgttttgtttttgtttttgtttttttgagtcggagtctcacactgtcgcccaggctgagtgcagtggcataatcttggctcactgcaacctccacctcccaggttcaagtgattctcctacctcagcctcctgagtagctgggattacgggggcctgccaccacgcctggctaatttttgtatttttagtagagatgggatttcactatgttggccaggctggtcttgaactcctgaccttgtgatctgcccaccttggcatcccaaagtgctgggattccaggcgggagccaccatgcccagccaagaaggtttttttagttcctatttacttttgaataaaatgtcttaatttttagaatcatgtacatttagctcttttatagttcttcactgcctattcatctttttagaatcttttttaattttaattgtctccctattaattgattgctttcaaattatcctgctacgtagcactaattacgagcttttaaccacttaatcaaaatttagcagattgggtcaagtgtggcagtggctcactcctgtaatcccagcactttgggaggccaagtcaggaggatcacttgagcccaggagtttcagactagcctggacaacatggtaagagaccatttctacaaaacattaaaaaaattagccgggcatggttgcgggtacctgtggtcccagctactggggaggctgaggtgggagaatcacttgggcccaggagtctggggctacagtgagccaagttcatgccactgtactccagcctgggcaacaaaggaagaccatgtctccaaaaaaaaaaaaaaaaaaaattagcagattgactatataagaattttaacagagttaatttgttgttaggacagtcccaaagaccaaaactataaagcttaaattcttgtttgaagttttgtgggggaaaaaaacaaaaacaaacaaacaaaaaaaacagtataaaactaaataggtgatgtgcctataattatgctttttaaatctcggaaataaaataacccaaaatgtttacaatgtctcaaaagataacacataggtgttttttttaactttatatctgtctatactttataagtgctcttcaatgggtgtatctttttatgattagaataaataaataatctagataaagggagattatgccagtgatagcagtaacgtttgtcattcttgtacttactgtgtaacatttctgagtcaggattttagactaaaaaccatgacttaactattagcagtttctttaagagctgatatttctgcaaagaaaaagagagtgcatgttctagatcatgtgtctacacagaatagttcctcaggatgcattatatccctgtctcttaactactcttgactctgctatccctttaagacgtacaacaattttacataaaagtttttctccatattctttttttttttttgaaatggagtcttgctcgatcgcccaggctggagtgcagtggcgtgatctctgctcactacaacctccatctcccaggttcaagcgattctcctgcctcagcctcccgagtagctgggattacaggcacatgccaccatgcctggctaatttttgtatttttagtagaggcacggtttcaccatgtgttggccaggctggtctcgaactcttgacctcaagtgatctgcctgccttggcctcccaaagtgctgggaatacagacgtgagccactgcgcccagcctccatattctaactacctcagacttcagggaaaactatttttaaaaacacatgtgggttttataaaaaccggtaagtttatgaaacttttacattagccctagccctcagtctccaagtccagtgtttatctcttaggttgtatagggatagttgttaggtcttaatttgcaggagtaacaatttgaatccagttaagcccacataaaaagtaaatgaaaaactaagagactcttccatttatggggatgacttgtattacatcctacagataccagaaaaatgttactgtaaggtgcgctctttttgaaatcttaagatgaagtcctttccagttacagaatttttgatgtaacacatcaaaaattgtttccctccaattaactgtaggaacagtaaactgtagcacagttttaaaacttacatagagagaagacagagaatctccctaaagcccaatgattaaacatgtctgttaatttgtccattagacgttttacaaaacagctctgaagaaaaacattttgttccaatagcataaaaatttgcaaaaatcaacctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagatactatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggattataaatcatgctgctataaagacacatgcacatgtatgtttatagcagcactattcacaatagcaaagacttggaaccaacctaaatgtccaacaatgatagactggattaagaaaatgtggcacatatacaccatggaatactatgcagccataaaaaatgatgagttcatgtcctttgtagggacatggatgaaactggaaaccatcattctcagcaaaatatcgcaaggacaaagaaaaccaaacaccacatgttctcactcataggtgggaattgaacagtgagaacatatggacacaggaaggggaacatcacacaccggggactgttgtggggttgggggaggggggagggatagcattaggagatatacctaatgctaaatgacgagttaatgggtgcagcacaccaacatggcacatgtatacatatgtagcaaacctgcaggttgtgcacatgtaccctaaaacttaaagtataataataataaaatttaaaaaaaaatttgcaaaaatctggaaatcagcattacctttttgtatttttgtttttattcatattttaatgtagttgaaattaaatgtgtctgtaagagtttagttcttaggtgggggagtccaggtaattatgaatcctatgcagagactgtcgcttgtcctgtcatgctttaatacaagacaaggaggaaacaatctatgtctttgccttgggaagtttaataatactgcctttgcctagaactgctattatttgttcagtcaacaaattcgagtgccctccctgtgcaatgaactagaaagtaaagaacgaatctaagacagtatcttaaatttaattcccccattctagtttaatcagtgttaattatcatgaaaatctgtgtcactctctgtcttccctctccctttttcttcctgactgcttcccttctactcccttttctcccccttcattcctcagcacacccaaattttactgcacctttctatcagtaattgtaggagaagggatatatgccccaacctcactgggcattaggggtgtgtgtgtgtttgtgtgtgtgtgtgtgtgtgtatccagttttttttaaggactaagtgtctcctaaagaagtctgtgctctttctgtccctctttttctgaattattgttttaaatcaagactttaaatagccacttaaacaagatgagtaacaattctcactggctcagtagctgttttttttccaagtatgttaaatatgttatattactgaaggaagaaatattttgtttcatgttttggggttgagtatatttgatatatttgtggaaagaaaagtttatctttgttttttgttgtttagaggaagttccttttgagcttatatttgagccccaaaaatcctccaaaaaattgttcttcctcttttccatgaatgagatttagagctaaattcatacaaatgcaaaacaaaataaaattacagattctctgaactctataactcctaaaaagattcagctatggaagcagagttgaaaatcacaagaattttggaggaaatgcattaaacagactggttatatcaaatcagaagatccacaaaaaatgcaaagagacaactgctgaatatatgtattcagtagaagcctgtgagacaatagcaaatttaaacccacccatggtttccatcctttgaaaaaatttaccttgagtaggacacaaaggaagaatgtcagctggtctattagtgtttccttaatggttcctgaggggaagaaaaaagaataattggtgtgagatgtgtataacaaagaagacatgcagagtattttttaagatggtacagtaattttgaggaaaaaaattaatattaaacgtctcctttttcttgttcccccaaaaagtgtgtgttccaccaaaaagtgtgtgtgcacgttctactgtcataccaaaaaagatgagactgtcccagagtctcagtgaattatcttatatttctgtagggaatcagattagatgataccctttagctttgtgtttatttgcttttggtaatgttccctattaagtggcctttctttaactcttctccttgttcatccttctatagtacctcactcttgtctattgattcataagttgccctctgtagaagcagtttaatatcatcagcttactatctgatggttaaaatgtctttcacttatacacccatgattctgtggaatttgtaagccagatgaattttttaaagccctttgtaaacttaatcctttaatctagaaatctgaaacaatggaataattcagtaaaaattatctattttcttagttttcactctatcaatatgaaaggctaggcaaacagtcctgatctgagatgaaaacagaatgtttcagaaatgctgcctatctaatgaaaccttaattgaagtatccttttgttgtctagaaaacttaaaaataacagaatcctgagcgtattattttttattgcttgaagtaactttagatatctagtctcactcttatactttatagctgagtaatgtaggggcctgagacctgtgacttgcttaagttcacatagttgatgaatagaagtagacccaggtctagaactgaatcacaagtcagttttcttatgtatgtactcatcacatgttgaattacatgctgggatatttctaaccatgaaatgggaagaacgcaggccactggttagaaagctacgagtttgtacccacaacacttgatgttgcaatctctgggctactacacaattgttcacttgatcagccaactatttgtttggtataggtaaagttctcttttatcctgcttaatttgaatataggtatcacttagacctaatatttctcagaatgactttgcagtggcaagtaatgggcctgatcttgtatttcagctcaaatagctataactgtaccaaagacatggaagaaaccaaaagatcggacccgaaccactgaagagatgttagaggcagaattggaggtaagcaaatctcttaagttcatattcagagcagtggtgccatttcatagacaggtatgtgtttatacctatttattgaaatagttttccaagcaaaacttaatatatcaagctcagagactaattgttttaagtccattttatattagaattttaaaaagatttttagtaacatgtttgatttcattgaatacttatttttctttcaaaatacctcttttaaaataacaaacttggccaggcacagtggctaacaactgtaatcccagcactttgtgaggtgaaggcaggatgatcactgcaacccaggagtttgagaccacctgggcaacataaggagaccctgactgtacaaaaatgttttaaaatactagccacacatggtggcgcatacctgtggtcccagctactcgggaggctcaggtgggaggattgcttgagccctggaggtggaggctgcagtgagatgtgatcatgccactgcactccagcctgggcaacacagtgaaacattatctcaaataaataaataaaatgacaatttttggttaaccttcctcttcccccaactagaacttttgtttgtattaactggatagaaagataatctggtaaacaaaaatggagagtttttaaaaataccattagtaatggtggtagaattcatctagtacattataaaggaattgattttgaatctgtcatctgttaactgcatcccagaaacataacttttcttcatatggttgtctgtcttaaaataagccatgcgagattttgcttcagattaaaacataccaagtccaagagatgaatgtgaggaagaaaaaggacaaatcagtcctaaggattactctaacaatttccttgtctgtaatctcaacatccttagcattatgtattgaagcttataaatgaagagcaatgtaaatctgtatgtagctttttccctttttttgactattcttttagctactttattaaaataattttactcaaggtttaacatgataaaattaaaattttactcaaggtttaacatgataaaatataaaaattatcttaagataactttgagtgtgtttacttcattcggcttttttagcaagttataattcttaccttctttgggtatctaacagtaccccttggttacctcccctgtgccttcattgctgttacatgatgctgtgttgatgtcactgttagtcccatagcaaccactaaaatgttgatcgttgtgatttcattgtggttattagggtgtaaaacttggcagtaaggtatagaggtgcaaatagtcattgcactccttttgcagctgaacctgaaaatgttcctcctacagagaataaaataccttccagaggcatgggaatcacatacattcctgctgtggctgttaagagcttcattaacttctttctttttagattcagctggtttttttgttatttttcttctgttatacttcatgttggatttctaagcattattgaatattatataggccactcctccattgccttcaaatattcatcctaatcttcagcttgaggttcaccaaactttttgtgtaaaggtccagatagtaaatattttaggctgtcacaattcctcaaatttgccgctgtagcttaaaagcagccatcaacaatgtgtaaatgaaagaagcaaggttgtatcttcacaaaactttattggtggacattgaaatgtgaatttgtatgccaggaaatatttttccagattttttcagatattacaaatataaatatcatccttaccttgtatgctgtgcaaaagcaggcggtgagccagaattggccctcgggccagagtttgctataaagcttctttagcttgttactcttgaaacacaagaactgttttgacttattttgaaccaatcactttttcttaactttatagtttaagacaaggctgggcgcagtggctcatgcctataattctagcactttggtaggctgaggcaggaggatcacttgaggccaggatttcgagaccagcctggccaacatgacgaaaccccatctctgttaaaaatacaaaaagtagctggccgtggtggcgcgcgcctataatcccagctactcaggaagctgagacaggagaatcacttgaacccagaaggcggaggttgcaatgagccaagattgtgccagtgcactccagcctggacaacagaacgagactctgtctcaaaaaaataaaataacctaaaaaatttttaaaaactaaagcaagacaaaaaatatttgctttttacatagtgacttctttcagaaatccttttttctgtctttcctaaaactgagcttttgttggcatagtgtagtaaatactggatgccattgtcttcatttccactaatcaggctccccctttcttagatttattttgtcagcttttaaaataatttgtttctggtatcagcttatttgggttacatattaggttgttgcattattaaagatatttatcaaaattatagtctagaggctgggcatggtggcttacgcctgtaatcacagcactttgggaggccaagaagggcagatcacgaggccagaagtttgagaccagcctgaccaacatggtgaaaccctgtctctactaaaaatacaaaaattagccaggcgtagtagtgtgcgcctgtaatcccagctactcaggaggctgaggcaggagaatcgcttgaacctgggaggcggagattgcagtgagccgagatcgcgccactgactccagcctgggtgacagagcaagactccgtctcaaaaaaaaaaaaaaaattatagcctagaaaagtaaggatgaaggatgatttcatattaaaattgcttggcaaagtatcttaaaataagttttaaaattttagagcatttcatcaattattatatacatagttgccagtctgattttctagcacttttaaaaaacattgcattaagcacagagttctgtcaagtgaattcttaacagattcctataaaaggtttacctttggctgtccagccaatgaagtcatctctttcttaaatctgtttctgcataaacaatttaggaactgtacagactagttgactaggattttatcctgctttaaaaaaaacccataaatatttaattaagctatttttgttattctcttcaaatacccctcatagtaatacacctcagataattcagtgattctgtgttctctgaattatggtttgttattcatagaactagtttctttatacttctttttccagttagaaattaaatttctaagtaatacagcctctgtttatatatgatagactgttgttgattgtaggtacagagaagaggatgcactgtattctctaaaaaaaagtttcacattttataagatctgaaataagaattctgtataattgtataatttggttatgttgctctttaataagtttaaataccatttacatactgatatctcagattattaaatgtcttcttgatgacctgtacttaattatgagatggtattataagattattataattagactatagtagagtctaaaatttttaaaaatgaggctgctgattcatgattcaaatttggtagatctggttttttcaatgtttaaatgatacctactttctgccatgctttataaaataaattgtttccaaacttatttttttggaatattatgtctgtctgtcttttgagggtttttatatactatctttttccatgaattagtcgggggaataggtgtggggtggtgtttgtgcatatttgcatgaactttttatttccattattagaaacagagtctaaaaaccatctgtttctgttgataacattaaacaatttattggcttttcaaccatgatctgttatatggtaaaagaaaatttactagtattatatctgttttaatactatctaacaaagaagtatttgtcactcaaaaattgttttaaacataatttcatagattatttggggtgaacttttttctgctatatatgacactactttacactatcctctgctgaaccagctccagtttttggctcttctcctcgtgtgaatttatcaattagaacacctctgagtagttgtttcagaggattgttttcagagtgcatacccatcgtgaaaagagttcacagagaactttgcctcaaggagttttgaagattcatgaggcctttacagagccatttgtgtttgatatctgacgctaagatggtcaaaaataatctagggaataacttcaattctttttcgccttctgaaaataggtgtgatactccataacccagatttctcttttttttttctctctctctctttttttttttttatatacaagatttttctatatggtcacagcctcagagaagtctaagaacgaataacaaaatagattttaactagcaagtggcctttttgtaaaatgagatatgatcagttttataggacttagatgttttaagctattctccagactgtcaatttcacagccagaagacagtgtaaaaaataccctccagtgtttctttttatatttgttgagctttaatggcaagggtagtgtagtgcttgttttagattctgactaggactctttcatgttcataaagttccatggattaacagttctttccattctaacctttggtatatttggatattattagtctcatgttaaagcatttcagcagccatttgaatggtcttccttttcctaggtgctgaaatgagaaaagtattttttttaaactcagcattctaataccacatgctgaacacagacattcttaccttgaatgacatgttttcctttgctttttgaagggagtagatgtaggtttttatgtatatttacacccgtggaaaaaaatgtaacctctttgttcatttattatttagcttaaagctgaagaggagctttccattgacaaagtacttgaatctgaacaagataaaatgagccaggggtttcatcctgaaagagacccctctgacctaaaaaaagtgaaagctgtggaagaaaatggagaagaagctgagccagtacgtaatggtgctgagagtgtttctgagggtgaaggaatagatgctaattcaggctccacagatagttctggtgatggggttacatttccatttaaaccaggtaagtttatacctgccttcctatgtacctctttatccctctactgcaaccttagagaaatgttgcctctttttagagagatactggatggaagaaagaggtttatcacaatataatatttacaggacagatcagcaagcccaagttagtgactagcaaatccagagagttctgtattgctggaaatgatacccgacactggtattccccttttactggcattggaagagcatctggcagagggaatcagacagtgccatgctagtgggtgcagtttgattttaaaaattattgcattcgttttaattgaaagggatatagagatattaccacattcctcgagatggcgttagtcatctttcataagacttgatctctgttgacagaaatcactctgtggaactgaattctgaaacaatgtattgagtacctgcagtatgggaagttccctgtggtaaatatgtatgataaacaagtaaataaggaatatatatgataaacatatggtaaacaaatataaaccctggaggatttttttatcttcagataccatcaaatgcattaaacctctgtcataatgctatataaactgtgactgactttgagatatatggagagatttggtatggatctgtaaggaaagatggttcctttgacagaaagtttgggctgggtgcggtggctcacgcctgtaatcccagcacttagggaggccgaggcgggcggatcacctgaggttgggagttcgagactagcctgaccaacatggagaaaccccgtctcgactaaaaatacaaaataagctgggcgtggtggcacatgcctgtaatttcagctacttgggaagctgaggcaggagaatcgcttgaacccggaaggcagaggttgcagtgagccaagattgtaccattgcactccagcctgggcaacaagagcgaaactccatctcaaaaaaagaaagaaagaaagtttggagtaggtgaaaagttttccttagtctgccaaatctagactaagttttgcaggaggtggggtttgagtgtaaaataccagacctcaaaggtaatctagatcaatatttttcaaactgttggatttaatacatttaatagattgtgaaattaataggtcacaaccaacattttaaaaaaggataatataataaaaaatgtcagtctattacatgtaagtaagaataagtattgtttttagaaactttgtagttatatatgtgtttataattgtcccgggtcatgaagtcattatgtcttactgtgagttgtagtcagagatgtttgaaaaccaatgactagtacttaccactttattttatattatttttaaaagtttttatttattgtttattttttacagagggagggtctcactatgttgcccaggctgctttcaaactcttgtgctcaagcagtcctcctgcctcagcctcccaaagtgctcccatgcccagcccttaccactttgatatactgatctttcactaccagtaaaatcctgttaatgggctttatgaaattgtaaatttatgctatcataaaactttttttaaaaaaaccctaggactcagtgtactcaattgcttttgtcaacttaggcttgtatactgtgttcaaaaataaagaaaaagatctaggcttgtaccaggtcacagagtacttgtagccatcaccaatgtgtcttaagaaaatggaaacactattgctatttttagactatgcaaattatatttttatattaatttattttatgttttaatattttgtatattgcataatttatgttacttatattttatattatattttaattcttttcatccatcagttttacagtataggccctgactataattgaccaactaccttttgcccttgtaatatttaacagcagtaattggaaaaaagacaatagtcattggaaaaaaaacagtttgaaatttagatcccaataagctgtctactttttaataaatataatagggtaataaagatatggtggaaaacatttggaatattctcaaagacccatcagcgggtctataacctacacattaggaatctctaatgtaagaaggatccaatctgctatcaggaagtaatctggagtctgattttgatgagttttattaattaaaataagaaaactgtgatttttttttagatgaaattataggcaggagaaaaaacttagtatctaactgcatagacagttcattatcttaaataagttgtttctgtgttttgtgtccttttgcttttttttttttctctaaaataacatttcctagtgaacaaccaaagtagccttttttatgaagccaagggttgtatcaggttccttatttcttagttatttaagttatttagttatttaagtcttatttctaagttatttatttaatgaggattattacatgtccctggccaaaggttacttagtgtgtatgtgaagtgattcctacttgctttagattattttactactcaaaggtatttagaagggatgaaagaacaagtgatggtttaaaatctttacatattttctgactgtatttcattgttcccttctattttttgtttgttcatgaagagataaatactggaatgtggtttgtactcttagggaatgtaggtcatgcatcatttaatgacggtgatttgttctgagaaatgcatcattaggcaatttcttccttgtgcaaacaaaagagtatttgcacaaacctagatgttctagcctactacacacctaggctgtatagtgtagcctactgctcttaggctgcaaacctgtacagcatgttgctatactgaatagtaggcagttgtaacataatggtaagtatttgtgtatctaaatataactaaacatagaaaaggtatagtaaaaatactatataaaagatttaaaatggtacactgtatagggcacttaccatgaatggagactgcaggacttgaagttgttctagatgagtggtgagtgaatgtaaaagcctaggacattactgtgtgctggtgtggattttataaacattagggcacactacatttattttaaaatgtgtactttctctaataatgaattaatcttagcttaccttaatctttttacttgataagctttttaattttttaactttttgacttttataataatatttagcttaaaacacactgtatagctatgcaaaaatatttctttttcctttttctttttctttttctttttttttttttttttgagatagaatctcactctgttacccaggctagagtgcagtggtgcaatcatagctcactgcagcctcagcctcctggactcaagtgatcttcccacctcagccacctgatagctgggactacagttgcatgtcaccatgcccagctaattttttaaaattttttttctagagattaggtcttactacatcgcccaggctggtctcaaactcttggcctcccaaagtactgggattataggtgtgagccaccatccctggccttgtttctttatatccttattctatatgcttttttctatttttaaaattatttatctttttacttgttaaggatttttcttaaaaactaagacacaaacatatattagcctaggcctatacacggtcaagatcatcaacatcactgtcttctacttccagatcttgtctcattggaaggtcttccggggcaataatatgcatagagctgtcatctattataacagtgccttcctctggaataattcctgaaggacttgcttgaggctgttttacagttaactttttttaataaatagaaggaatatactctagtgatttaaaagtatagtacagtagatacataagccagtaacgtagttatttcttgttactatgaaatattatgtgttatacttgattgtatgtgctatacttttaaatgactggcagcacagtaggtttgtttacactaccattaacacatacatgtgaataatgcattgtgctgccacatgaggatagttacagtgtcattaggcaataggaacctttcagcttcattatagccttatgggctataatgttgtatatgcagttgtatatgcagtttgttattgatcgaaacatcgttatgcaatgcatgactgtatataatgccctacaaacagtgtctgcctatattcctctttctagaatcctggaagcctactgatactgaaggtaagaagcagtatgacagggagtttctgctggacttccagttcatgcctgcctgtatacaaaaaccagagggcctgcctcctatcagtgatgtggttcttgacaaggtaagctgcgtactcagagaaaactagttctttttggtgggaactgattttaactataagagcaaatatgtgaagtatgagcagtttttagtaattgttagaccaaatgatgtaaaaatatctaatgtttaagaatttgtttccctaaacactgttggattttgagtttcttataggttacagtcattttgggatttggcccatgttggagtggtggttttttttaatgtttattgatttatctgcttattatggctgttttttggtgaaataaaaaattttgtgtttgttgggggaaacatggctaaattgatacggaggtctttcctcattgttctaaaagttcattatggaattctattggcattgaagacaggtcagaaatctaggaaggtatttggcagatcaaacataagtgagagtcaacatgattcaaataatatgtatctcaaagtttccctaatagatacctccagtgattgaattctccaatcttgtgcaaataggcatccttcctctttgcatctgatctttatggtgcacacagcaaattagtacagtcagtatttgtttactaaattaaaaggagtaaagtcagatctactaaagtaatttcatcagagctgatgattaagcttgaagtatttttgttttgtagaggaacagaaatgtaaaagtagagattaactatcttatggaatcatatctacctcttaaccgatttatgcctagtgtttcattattggaatgctaagtttgtgagagttatttatatcctactcttcaaggtcataaccaaggtctgaattttcacgcaaaaaaatttgcagcctccggcataaatgggttagtaaagatgtccagcagctgcttatccagaactcatttatactattttactttcttatagcaacaggtcttcttacttctattggtggtatctaagtcttctctcctagatacttatgtgaggacagctgaatgactgattaatggtgctaatttgaggctacttcagtacctcagaagtcaagtgttatatccaccaaattcaattatcctcttagaaaatattcctgcctgtcctgctgccttatctgtttatgactttggccactaattagttgatttctcactgatctgcttaactttatgttgtccatggtcacattacatgcttattcaaagtcagatatctcagattaacaaggcagacagtgaaattttaaatgaatcatcacctatgaaacatgtctcctctaagacttattgtccactcatagtacattctttactaaccataagtctacagcatcaaaactaaaatgagcagtagcaggattcgtataggcaagtgctctatatcctgatgaatatttttttttaattctaaaatttgaccctagtatagaggatctcaaaatatcttgtcttgtgccattcagttggtcctcagtatctagtgagccagtctgctgattatgtatagcccctacttggaaatttaaggcctaaatcattcccagcgtatcagaaaaccattgttttagcctaatggctctaagagtagcccaggagaagctgccatggatgagattggacttctgcgggttccaaagctggtgcttaccgtttcagctgatgtaacttttcagtaaaaatttttgttatcttttgtggcagggaatgctctggaacatgtattaagctttcttttgctttttcatgcagatcaaccaacccaaattgccaatgcgaactctggatcctcgaattttgcctcgaggaccagactttacaccagcctttgctgattttggaaggcagacacctggtggaagaggcgtacctgtaagtgcaagttccctacaactcacttagttagacactggcacagactccatgaaatcctacctcatggcaagacagcagcttttattcgttgattctagtcaagaagaagaagaagaggcaaagactatcctttccatactcatattaaagcagataaagaatacacttgagttctttttacttggcagaagctagtctgcattaatttggtcttgattttttttttccctattttttcaattgaggtgacctgcaaataggtttaaaaatagtgccaaccatggccagggatggtggctcaggtctgtaatgctagcactttgtggggtcaaggcaggaggatcacttgaggtcaggagttcaaggtcagcctgacaacaaagagagaccctgtctctaccacaaaaaaaaaaaaaaaaagaaaagaaaaaaataggccaggcatgctggcgcatgcttatagtcctagtcccagctactcgggagactgaggtgagagaattacttgaccccaggaggtccaggctacagtgagccatgatcatgccactgcactccagtctgggtgacaaaacaagaacaggaagtccaggcttcagtgagccatgatcatgccactgcactccagtctgggcgacaaagcaagaccctgtctctgaaaaaatatatatacagagcgagccaaccttgataagattcctgttttgttttgaggtgtcctaaaatactggagatctctgatgacattcagctaatgatcatgtctttgtctttgtttctacagatttgcaaagtgcagagcaggcatggattgccaattctggaacagagcaaagccccaacttgccctccactggtgatgtcacacccacccatgaagagcctgcctctaggggtgcgctgaacactttgttttttgtaataatagtctctggtgttataatattttctgttacgctctttttatttactattgattgttaagtcaaaattttaacaaatgacatgtacaaaagagtgcagtattggtaaactgcagattgccattacacccccagtggcaggctctttcagcggtggaagtggcatcaccagtggagttatgctggggcactgcactgtgcaggattcggcaggctctgcctactccatgctttgtagacttgcagaaagcatggggaaagttgccaatgatgttgaatgtctcttttccccaagttagaatggcatagagagcaataaatctaacattttggaggagcttggggtttgatgtacatttgcagataaccgtgttacttcattttatgtaaggtgacactttttgtttccgcatcacctttttatttctgaaatggcaacttttgaaacctgctttgaaataagactacattgtctgaaaacaaatgtcactttgtagatatttaaattatttgattattttcctgcaaccgaacagtgatggcgtatacttgaatgcctacagtgtgttggaggctttgtaaaactaccgaaaaccacctgaatttgaagcatactgtttattgagccattaatccatcaccattttagagacctgtgtatgtgagatactctgtttctcacacatttatctattttcaggaaatactaaattaaaatttttctaaatcttgagttacctcaccagaaagtcttagaaagcagctttctagaaaccattttatacccttttttttttttttgagacagagtgtcgctctgtcgcccaggctggagcgcagtggcgtgatctccactcactgcaagccctgccacctcctaggttcacgccattctcctgccttggcctcccgagtagctgggactataggtgcctgccaccacgcccagctaatttttttttttttttttttttgtatttttagtagagacggggtttcaccgtgttagccaggatggtcttgatctcctgacctcgtgatccacccgcctcggcctcccaaagtgctgggatgacaggcgtgagccactgtgcccggcccattttataccttttttttcagtattatttccctttttaatgttgaaatttttatttgtgttactgttcattttggttttggtttatatctttgttttgccaaatatttgaaataatgttgatgctattttgaatattctgtggataatagcatctgtggttattatcatattgcccaatgttgttgatatgtgactcacaaaatgtataaatcctcttccagtgtcacttttcactaacagcttgctagtcattgtttgctaataactagttataacaaaaaggaaatattgtgagtttagaataagcaatgtctcttttaaattattgaaaatagaaaatgattttcaaaagtaactttatcacagcatataccactcctctgtatacctacgtatgtgagatcagtgagttattctggtacactcaaagtaatgtgactagaagtgagatgttatctagaatttgtagtagctccaaaaagatcaactttaattatttaatttacttttattaagcagctttgttctgtgtcagaagctagtttttaagagaaattttgatgtctcagggtaatgttgatatgttaagccttaacacaagttattcttccagcctatctcctagataacagacattctccacttaatttgcccagcttaccttggtatattgatgtagatacagatgggaatgtcataggacataaatatcaacatataaaggaacaaaaatggccaggcacagtgactcatgcctgtaatcccagcactttgggaggccaaagcgggtggattgctagagtcccggagttcaagaccagcctgggcaacatggtaaaatcctgtccctacaaaaaatacaaaaatttgccgggcatgagggcacacacctgtagtgccatctacttgagagactgaggtgggaggattgcctgagcctgggaaacagaggttggagacagaggctgcagtgagccaagattgtaccactgcactccagcctgggcaacagagtgaggctctgtctcaaaaaaacaggacagaaataatgctgtttggaaaaaagcaacagccctactctttgcagtttctgattccatacttcaaataactttttccagttctccaaattatcttataattaattatcacttaatgatattaaaatctatgaggtatgccccattattatcttaagtagccatgacttctaatataaacttttctacagctcatgcctgtaatcccagcactttgggaggctgaggtgggcagattacatgaggccaggagttcgagaccagcctggccaacatgacaaaaccgtgtgtctactaaaaatgtgaaaattagccaggcgtggtggtacatgtctgtaatcccagctactcagaagactgaggcacaagaatcgcttgaacccgggaggcggaggctgtagtgagccaagatcacgccactgcactccagcctgggtgacaaagcaagactctgtctaaaaaaaaaaacaaaaaaccaaaaactttgctgtaacagacttgctataaaatatttttaatgtatgccaatgattttaaaatgtcatatgcagctacgtagttttcaaacctaagtgtccttcactggatagtaaagtgcatatctgttggaaattaccatgaaatatcatgtctttagttatttttaaaataaaattatgggccgggcgtggtggttcacgcctgtaattccagcactttgggaggccgaggcaggtggatcgcaaggccaggagatcaagaccatcctggctaacacggtgaaaccccgtctccactaaaaatacaaaaaattagccgggtgtggtggcgggcgcctgtagtcccagctactcgggaggctgaggcaggagaatggtgtaagcccgggagcttatagtgagccgagatcgtgccactgcactccatcctgggcgaaagagcaagactccgtctcaaaaaataaaaaaaataaataaaattacttatcagttgtgttagtagtctttttgcggacatcacagaaagcactccaaaaaatatatcttaagaggagcattggacctatataagtaatttgccatttatacttattttaactaacttttgagataaactgatcaatcataaaaatcctagcagcaaagaagaatcctaggagtaaagtctttctttaaaggaacacttggttgtcttccttctttaaaaatttaggtgtatattgattctcttttctttggttatccaagtaggcagtggaatttaagattacagtctctgaataagataggaatgatgtatattaaattgcaaaacggagatgggtataatttcataatacatttttgaaaactgacagtgggtaaaaaatgcaaactttaacgtcacctgaaaaaagaaaatggctcactaatcaaccccagactttgagatttttagttttgacattgtggaccttgagcacattataccttaaagttccttaaagtactgtctttcaaagaaagaaaccaggtgtcgtttctttttgtgtagcccatacctcttagcacaggatcctagattttttgtgtgtttagtatataaatcattcatcatatgttgctacttctgaaggataccataaatttgattatctgtattaagattttcacacacaaaaagggacatgaaatgtttaaatttatgtatcagttttttaaaagttccttttgatcctttggtgttgatgataatatagtttttagggtccttttacatggtttatatcctataatcacaataatgttttcaggtagggctggcattgtatatatgagaaaacaacaaaactaagagacttgcctatagtaactttgctcatatatagcagatttggactctagattctgattcttttgtctcctaagttcactacaccacagttttccaggcattgctattccaaacagtgaattcattctcagagtgtaaatatgggcacattagagattgattaattgaacatattaagaatttgtaagtatagtagatctattaatagctagataaatatttgagaacagtgtctttatcttagttataaccagagatacaattataatttaaaattttttcttgggtgctttcacgtgggttataattttaactattttatcctggactaacaatttatcagttagcttttcaaagttttttttcctttgaagcattattgttactttctcacgtctctctgttgctcatttgaaactcacacatatttgtcttgggtcaggtaaagaggtgtggaataaatcatattgccattttccagattcaaatctcaaggcatatttattcattggtgtttgcagtaggttttggtaatgggcattttctgactttgtctcctaatgtgcatctatggctcttaattggttttgacataatttcctttcattgcatccagaaacatttgttcttgacaatgtttatgtacaaatgcatggattaaattaaatatcttgtgatataattgtttacctgaggtttagccaaccatttagtaagttattaatccatataagtcaacactagaatataacttgaattataaaaatcaggcattacttgattaccacatttttctatcagaattgtttcttctgggctactatattaaagtttcagttacaatttatgttcttatagtagtactgtctggtttaacaactgttccctgttggtatttttccaatctgatgatctttatttcctttcagttataccatgtgtctcatacctctgggtttatctgacctgtttgttttttttttttaatgtttatcaaataatctgtgatatcatcagtactgtatccttagctggatgcatttgacaagattggtgtgaaattttgcagaaaccctaacttttgatcctgatgcattcttgatactaccatttctaattggggcagatggtgaagcataaaggaataattctgagaatgattgatgtgtaaaggtgtttgagcttatcagcttaggccccagactgtgttatcgcctagaaactgtatttttatgtaatgaatgacattaaagtctagacttttttctctgaagcgttaaatgaattcaaaagggcagcattggggccttaagtgagaaatgattctcatctatgtgtgctttgtatgaagtttttattctctcttgaaatctaatggctagcccttcagtgcaactcagaaagaaaaaaaaaaaaatctggtggcagtatttgcccagcactaacagaatgatatatcagaaaaagtaaaggttgtcaacatgcagcaggtctgcttgaaggtagcagagcttagtatcaacccaaatatttaaccttgaaaaattatttccaagcatttaagatagtaattatgaatattttgatacacaaaatgcaacttttaacttactctgttatctctacttagtgtgctggcagtataacatggcaacatacattggttttaacataagggtatagtgggaatccagcaggaacagagcagacaaataaaaggaagccttttttttcagggagtaatttagtttgactctcattgatgatatataacgggcttattttagtatttctgacccagcataatgagtggaatcttttatgatctacagtaaggcttagtgatgatattaaatttgcattttaccctgggattgtagaaacccagttttagcagatttgtaactatgatgatacctacctgtgaatttttgtaattattgaagtgaccagtccacagttattcaactaataaaagataagcttaaattaggactagtctttctcattagaagtaacggctttgtcaaacatctggttcaaaaaggcctcttgttcaaaagttgtagtggtggagaacattacattgatggtattctgaagttattttttttacccccaaaaaagattacctccagtttgagtacctagtacccaatctttgcatctagcattgcttggcgtagtcatcagacttgacttgaacagcacaacaaagccaataaattgtaagtactctgaatagctgtaatattcttgtcctagttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgatgatcccgaaaacattaaaacccaggtgagaacaaaagcatatcctaacattcttttgaaattatattgattttgttttaacttattttgctttgctaatgtttctagagataatcagtttaagactttttataacattttcctattaaaagaattattctaaaagccattatggatgccaggcaacctactgttttctcttgaaattgctttatgtgtattttttcagaatagttaccaggtctagagggttcatgtgtcatagacttatgtaattcaggcttaagttaatatttgcttttctttaaaatacatttttagattctcagtgattgagtctctttatcctatttatcctaattattacattgctttatgttccttgtcaggccttcattgccaataagctagaatttagaaactcatcttgttttgaagccttttggaataaaatttaattctttgaatctttttatgcatatcctgccctcagaactatgaggataaattgaatggatttattttattgacacaaaattaatttttatgtatcagattatataaagcctttatttatcttttgctttatacacaatgtcaattcctatccccaagttacctctgcgacttgagatgtttttgcttctaggcaccaaaactggagtctcttaaaattcacacttgtaccagagccaggcatcacagatcacatactaacttttcagcatctggattccttatatatcttttctctcaccatgaacagttaagtgtagcagttcaaagttccagctctggaggcagagtcctgactctgttaggcaggttcttaatctcaactataaaatgaagttacaaacattgagtgcctcatagggccagtgttaagattaaatgaaataaatataaaccatttggcatggttcctggagcgtggttaagtgctcagtacgatgatgtccctgagatcagagatgtgccttagatatctttttgattcagtaccatcacataacctcagagagcaggggatccccaacccctagtaccagtcagtggcctgttgggaacggggccacacagcaggaggtaagtggtggcaaaagagcattaccacctgagctccgcctcctgtcagatcagtggcagccccagattctcataggagtggaaccctattgtgaactgtacatggaagcgatctaggttgcacgctccttatgagaatctaactaatacctgatgatctgaggtggaacaattttatcctaaaaaccactttcctcttccccgctcaaccccacccccaaccctggtctgtggaaaaattatcttccacaaaaccagttcctagtgccaaaaggttgaggaccactgttagagagagtaaattctcagtaaataattgttcagtaaataagcgaacccacagagtagttaatacaaaacaaagatgaagatgaggcaatccaacaactagccatgctgtcaaactgtacttggcggtttgcttttgtttatctctttagtgattatccccaaacatttgccacagggttcctaaggacatccttcatcacattgctgagataattctctccatttcaacatatctcaaccttttttggaaaaaagaaaaaaaagtcttttttgtccttctctccaatctccgtgagaaatgcttaatgataatgggcctaaatggcttataaagatagttaaaacttcctactggatcttcatcattgacagtgaagatgtatttaaggcacttggattaatgctttactttattaaattcttactgtacctataatgaggaaatagatgttatccttttttttcatgaggaaactgaagcttcaaaagttgtcaagcgtcatgaaagatactaaatagtccagttgttataactcgtaatctgtttctgtttataacagagtcctctccgttattgtcttatttcagaaacagaataattatcttgatatgaggcagcattaattaataggttttctttagtaagtagataaaacaaatctaatggagaatttttaaaattcctttacagagccagtacaaccttcttttttcttgacactttcttttaaatatggacttgctttgttgccttcccttacgttcctactactatattaaatcagcattgtgaacgaccactgttgatgaccttattctcatcttcttgaagcatttttaggatatcattgcctcaggacatgtctgggcttctacccctaggattccctgcattctctttcttctttctcctctattacaacatttctactgatgctgcctgagtcatctacctgaaacactgatttttgtctttccattcgagctttttaacctagcattcaatatgtcattttcactcacagccagtgaaaactagtcttctgatatttccagcttgttctctcaattagcaagctagaaaatcctcattaacaattccttcctaaagtgttttctccttcataaaatatctactttattttttttcttccctttacctagctctttctgtcctttattatctggcccaattctcatttccttctttttttttttcttttaagatggagtctcgctctcgctctgtcacccagcctggagtgcagtggtgcgatcttggctcactgcagcctccgcctcccaggttcaagtgattcttctgcctcaacctcccaagtagttggtattacaggcgtgtccaccatgcctggctaactttttatatttttagtagagaccaggtttcaccgtgtaagccaggatggtctctatctcctgaactcgtgatctgcccacctcggcctcccaaagtgcggggattacaggcgtgagccaccacccccggccctcatttccttctaaaggcattcctcgactaatccagttcctctgacctcatgtacctaaactattcccctttctggtctctaatcaaccctagtacttgctttatcacttcgtttttaaatgtattgtccctgcaactagattttgattctgtagaaggcaataactgtgtttcgtgcttcatttgtacctaacacagaatttactggacatcaactagatatttagttatagcgaaatgttttttttttttttgagacagggtttcactctgtcaccaaggttaaagttcagtggctctgtcacagctcactgtagccttgacctgctgggctcaagcgatcctccctcctcagcatctcaagtatctgggactacaggcatgtgccaccatgcctggctgatttttttgtagagaccaggtctcattctgttgcccaggctggtcttgaactcctgggctcaagcggtcctcctgctttagcctcccaattgctgggattccaggtatgaactaccatgcccaggctttttttttttgaaagagggtcttaaatctattgcccaggctggagtgcagtggcacaatgatggctcgctgaagcttcaacctcctgggctcccacctcagccttccaagtagctgggactataggcatggaccactatacctggctaatttgttaatttttttttgtttttttttgtttttttttgagatggagtctcactgtgtcgccctggctggagtacagtgacgcgatctcagctcactgcaacctccgcctcctgggttcaagcgattctcctgcctcagcctcccgagtagttgggactacaggcatgccccaccatgcccggctaattttttgtatttttagtagagacggggtttcaccacattgaccaggctactctggaactccgggcctcaagtgatctgccctccttggcctcccaaagtgctgggattacaggcgtgagccactgctcctgggcctaaaaattttttagaggcagtgttgcccaaactcctggcctcctgcagtcctcctgccttggcctcccaaagtgttgggattacaggcatgagctcctgtagcttatccaataaatgattttgtgtgtgtgtgtgtgtgtgtgtgtgtgtgtgtgtgtgtaatttttctttttttggagacagggtctcactgttacccatgctggagtgcagaggcatgatctcagctcactgaaggcttgacctcccaggctcaagcgatcttcctgcctcagccccacaagtagctaggactacaggtgcttactacacacccagctaatttttgtattttttatagtgatggggtttcgccatgttgctcaggctggtctcgaaacccctgagctcaagcaatctgccctcctctgccttccaaagagctgggattataggcatgagccactgcacccggcctcatttcattctttcagcagtgtctttcacagagcagttgtttttatttttattttattttattttattttattttcattattattattttttgagacagggtctcactttgttgcccaggctggagtgcagtggcacaatcacagctcactgtaacctcagcctcccctggctcaggcagtcctccctcctaaacctcccaagtagctggaactacaggtgcgtgccaccgtgctcagctgatttttgtattttttgtagggacagggttttgccatgttgcccaggctggtcttgaactcctgggctcaaacagtgcacccaccccagcctcttaaagtgctgggattataggcatgagccaccatacctagcctgtttttaattttgataatattgaattagtcaaccttttctttcatgattgtgcttttgctgtcatatctaagaaatacttgcgtaaacccaagaaaacaacacttttctactatgttgtcttttagaagtttatagttttaggtttcacatttagctttgtgatccagtttttgttgagttttgtacaaggtgcaagataataggtcagggttctttttctcccctttcttgtggatgtccagttgttccagcaccatttgttgaaaagattatcctttctccattgaaatgttttggcatctttgttgaaaatcagttcatcgtatatgtgtgcatctatttctagactctacattcttcttcatctagctatgtgtctgtcctctggccaacaccactctgtctttatatagaaagttttgaaatctggttgtgtgaattcaattctccaactttttgtttttcttcaaaattatttaggctcttctagggttttgtatttgtgtgtgtgtgttcatataaattttagaatcagctccttgttttctacccaaaacaaaaaacaaaaggccctattaggatttggattatgatgatatatctgcagatcactttggggaaaactgacatcttaacaataatgaatcttctaatacaagaacatgatatatatcttcatttatttaagccctctttgatttccttcatcagtgatttatagttttcatatttttttccatcttttttgttttgagacagagtctcactctgttgcgcaagctgcagtgcagtggtgcgatctcagctcattgcaaccgctgcctcccaggttcaagtgtttcttctgcctcagcctcccgagtagctgggattacaggcatgcaccaccacacccagctaatttttctatttttagtacagatggggttttgccatgtcggccaggctggtctcgaacctctggcctcaagtgatccacccaacctcggtctcccaagttgagattaaaggtgtgagccaccacgcctgaccttttgctagtttttggctaaatattttgtagattttggtgctgctgtaaatggtacttaaaaaaattaatttctggttatttattgctaatacatagaaaagcagttgatgtttgcattttgacattgtatcctacaattgctagactgacttattctggtctttttgcagattccttatgattgtctatgtagacaattatatcttctctgcatagagttttatttcttcctttacaatctacgtaccttttattgctttttctttgctttatttcattgattaggacctctggtatgatactgaatgggaatggtgaaaagaaacattttttgcattattctcaatcttaggggcaaaaatcattttgcctttcacctttaagtggagttgtatatctccttttactagtctaggaagatctcttctattcctgttttttttttttagagtttttacaacattattttaaaagactcctgcctagtgtttcataccattatttatattataccataatttagacaaatttctatttttttacatcaaagttattttctgtaatgagttatgtggctaaagtatttttacgtatctctaaatataaatacatttctaaaagtgtaattactggttcaaaggttacatacacagttttaaagcttttgatacacgttgtcaaattgcccttagaaatgttaacagataatgctcccaccagctaagtgtgtatatacctatttctagaattctcctcagtagtgaaaagaaggtaatttttgactatttgttaaaatagattagtttaattatttctgtcactagttcacagtccttgttaataatttgagaagttgaacttatatattatttttaaaattaatcattacagaaagcaccatattgtcacagttactctaatgcttttttcttttttgtggcccttctaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacggtaagaagagaggaaggagtaaaacgagaaatcttcaagaggtatattctcccctcactacacattcttcccagaagtgttattggggcaacataaaggggagaatatatttttagtatttattgatataatattctcattattaaagacaatcttgctttattaaaacgtatactcccctctggaggggatatgaagtctggactgaaatgggcatgagatgggcccattcagcgtaagaaagatagagtcaggtttaaattagtaatgtaaaattatcgtcatgggcaacaaatttttcccgtgtgtctcttatggaaagcaagcaaatgcgtgctttcacatttaattaagtttgaaatttaaaaacacgttgattctaattctaatctctgtgaaaatgaaaggatagttgttctgtagtcaaaaaggtttcaaagctgataatttcatgtcatagaaactgttaggtttctctccgtttacattatctgaagccatttaatctccacagcctgtcaaacctagggcaagacagagagggagaccaaagagcttctggttagtgttcattgtcctctattccacagtcataaactgccatgtatcatctgttttctcttcctgttattgttaccgaggtacttgtgtcagaaatgtctgtcctttaacatttggattttttcttaattattacaactcattgtcgtgccttgctgcttagaaacaagctatgaaaatgcaaaattctctcattctaccaatatttttgactacctatgtcaaaggtaggtaagtcttttggggtttggaaaagtcacatcttctgtcttaaaggaattcaaaatccatttgaaaataagtatttccaagaaaaaaattacttaaaaggtattttgtgatgtagcagtatctcaatgcctgaatggatggttagaccgaaaaataagttggaagaaaaagaaaacactatgttggtgggagagtcacaaaacttttataaagcaaatagagtttgagttggacctgacacaatggggaatacacatttggagaagaaagaacacattctaagcaggctcaagtctgaagcagtaagtgtggctttggagtcacagctctaggtttaaaatttaaagtttaaaattaaattccaggctgggcaaggtggcttatgcctgtaatctcagcactttgggaggctgaggtgggcagatcacctgagatcaggagtttgagaccagcctgggcaacatggggaaacttcgtctctactaaaaatacaaaaattagctgggtgtggtaacaaaaattagccaggcatggtagcgtgcgcctgtaatcccagctacttgagaggctgaggcaggagaatcacttgaactcaggaggctgaggttgcagtgagcagagattgcaccacaacactccagcctgggcgacaagagtgagactctgtctcaaaataaaataaaattgagataagagaagatagtttctactctgccacttcctaactttatgaccttagaatagttactgatctctttaagcccctgtttttaatccataaaatgagattaattcataccacttgtaatattataaggataaaattaattaaaataaatgagattacaaaatttctagcccagtgtttggcctgtagtaagccctaaataaattgaaactatgttagaccttttaggtccaatttgtgaaggttttgaatgttggctatagaatgaggatgattattataataaaaatagtctattcagcacctactaagttgcaatatggatagaggctttatatatacatattatttttaatggttattctaatcctgaatggtcagtgttactagccccactttattgaaccaaaagctgagcttgaaaaggaaaaataacttctcagggtgatgtaactagtaagtggcattgctagaattcaaatcagggattatttaactcaatcacttgccatagtgcctcctgatgtgccatagttatatggaagcaaactaattctccatttctgggctctcattttcattgtggtagccatgacatccatgactcattaaaattaggactagatcccagatcctctggatcacactttaatgctctttcccagttttgaattttatcagataggcagttaagtggtgtttaggtagtttaatggaggagtgatattgatgaaaatggcctttgaaatgatctggcaataagtacaaattggattggaatatgaagaaattatagacaagccacccacttatgagacttttgaaaactttattggattgttttatttatgtattttgcttgagacaaggtcttttgctctgttgcccaggctggagtccagtagcatgatcatagctcactgaggcttcaaactcctgggctcaagcagtcctcctccttgactataggcacacaccaccaccaggcctggctatttttttatttttggtagagatgaggtcttactatttgcccagattggtctcaaaaactcctaggctcaagtgctcttcccgccttggcctcccaaagtgcagggattacaggcaggagccacctcctggcctcctggattattttaaattataagataacaacctatttgaacaagtcaaatggtatagttaatacagttattactctctgcttgcagccccagccagttaatcttccttccctatcagatggtcactgtgaatggttttgatgtaatcatctatagttttcttcatgtttataaaatcacatgaaaatatgagtatgtataaagaggtttttttggttttgctttaattgaattatataaattattttcagtttgtttttttttttttttttacttaataaatgttttgggcagccgtctaggtcattacagatagattttactcatacttttatactaattgcataatatttcataatatgcatataccataacttgttcaaccatctctcttctctctctatctctctctctcatatgttcatttatccttgtattctggagcctgcctccctccctccttgtctttttttttttttttttttttttttttgagacaggctctcactctatatcccaggctggagtacagtggtgtgatcacagctcactgcagcttcaaactcctgggtccaagcaatcctctcatctctgcctcccaagtagctgggactacaggcacatgctcagctaatttttgtatttttttgtacatgtagggttttggggtttcgccatgttgtccaggctgatctggaactcctgagctcaagtgatctgcttgcctcagccttccaaagtgttggcaccatagacgtgagccaccatgcctggcctctttcttcttttccttccccttccctttcctttttgtcttgctctgtcacccaggctagagtgcagtggcaggatctgggcttactgcaccctcaaccttctgaggtcacatgatcctcccacctcagcttcctgagtagctgggaccataaacatgcaccaccatgtccagttaatctttaaattttttatagagacagaatctcaatatgttgcccagactggtcgtaaactcctgggctcaagcaatcttcctgcctccttcccagagtgctgggattataggcgttagccattgcacctgacttttatttctttagtgtatgtttttaatgttttaaacttttttattgaaatatgactaacatatgtgctttctgggttgaaattcttcatttgttgcatttgccaaatttaatgatgtaaatgctgtcctcaggactatttgtaatctactgacagtttgacaagactcacaaaattactgttaaacagttgtctgtcataaaccaatatgaaccagcttcaacacaccaatgcaacatgcttacagaaaggtatacaaatcattactgtacagctcattgtatgtcagtgaagtgaatacaccttagacccttttcaatactctttagtcttttttaaaggtaactaggaccaggtgcagtggctcatgcctacagtgtcaacactttggaaagctgaggcaggaggatcgcttgagcctaggagtttgaggccagactgggcaacataatgagactctgactctacaaataaaaaattaaaaaatgagccaggcatgatagtagtccacctgtagtcccagctactagggaggctcaggtgggaggatcccttgagtccaggaggtcacggctgcagtggaccatgataatactatggtacttactccagcctggtgacagagtgagacctagtctcagggaaagcaaaaaaggtaaccactgtcctgacttctgacactgtagttgattacttttgagggattgagagactgaaataaaatggtaacagtgaacatagaaacatagaatcctactacacacatcaaacattatgggattattaaatatctaaatttgaaaagctaaccttttataagaatatcaaggaggctattttcatgaacttttgagtagggaaagatttctttagcaaaattcaaaacatgaaggataaaggtataagatttgactgttaaaatttataatctttgatgcagcaaaagatactataaataaatacaaagataaaaccacaacctaggagtatctgtttggagtgcattaactgacagaatattagaatccaggattaaggaagaaaaagaagcaaatcagtaggaaaaaaacagcctaataaaaatatgggcagttcatagaaatgaaaatccactgggtgataaactttagaaaagataatcaatgacagcacttctcaaaataagacatttacgcggccaacaaatatatgaaaaaaagttcaacatcactgatcatcggagaaatgcaaatcaaaaccacaatgagataccatctcatgccagtcagaatggcgattattaaaaaggaaacaatagatgctagcaaggctgtggagaaacagaatgcttttacactgttggtgggaacgtaagttggttcaacagtatgacgattcctcaaggatctagaaccagaagtaccatttgacccaacaatcccattactaggtgtataatcaaaagaatataaatcattctactataaagacacatgcacacgtgtgtttattgcagcactatttacaatagcaaagacatgaaaccaacccaaatgcccatcaatgatagactggataaagaaaatgtggtacatatacaccatggaatactatgcagccataaaaagaaatgagatcatgtccttttcagggacgtggatgaagctggaagccatcatcctcagcaaaataacactggaacagaaaactaagcactgcatgttctcactcataagtggtagtttcacattgagaacacatggacacagagaggggaacaacacacaccagggctttttgggggatgggggttgaggggagggaacttaaaggacaggtcagtaggtatagcaaaccaccatggcacatgtatacctatgtaacaaacctgcacatcctgcacctgtatctcgtggtttttttttttttttaaggaaaaaaaaaagacattcaatgttattcattattagggaagtgataaactaagaaaagataaaccatagttctgtaaaattcacccccactagattgaaaaaaaaatcccattttaaatgtttttaaagacgaatataaccatttatgagggcaattgggcaataatgttgaagatgttcatgtactatgcaataacatcaaattgctaaatgtaccagatatttacaaacgtgaaacaacaagaactctcgcatactgattgcaacagccactttggaaattgtttagcattatatactaaagctgaagtttttctgccataactagcatttcaattcttaggtatatacacaaccaataaacatacatatctcatatgctaggaaatatatacaaaaatgttgtagcattttttatacaggaaagaaaaatgaaaaaatgcctgttgatagtagaatggataaatcgtagcatgtttatacaaggacagtgaatctgaagtacaactacatgggcatggattctcacaagagtaagtttgagtaaaagagggcagacccaaaaagatactacatgatttgttatttaatgttcaaaaatgaaacaaaaactaactttggtgtttggggatacctgtctatagtgttaaaggttgcatgttttctttgtgaaacaaaagcaaggctgggcgcagtggctcacagctgtaattccagcactttgggaggccagggcaggcggattacctgaggtcaggagttcaaggccagcctggccaacatggtgaaaccccatctctactaaaaatacaaaaattagctgggcatggtggcgcatgcctgtaatcccagctacttgggaggctgaggcaggagaattgcttgaggcaggagaattgcttgaggcagggaggttgaggttgcagtgagctgagatcatgccactgcactccagcctggccgacagagtgaggctctgtctcaaaaaaaaaaaaaaaaaaaaaaaggcaagaaagttataaaagtctaggaggcttttgtataactttggagacaaggggttgtggatgtgctttggaaggaaatttaagtggagcttctgagaagctttcagtgttctgtatcttgacctggttaccatacctggtggtatttatggagtttgctttttcataatttattgctgaaccttaaaaaatttttgaaacaaaaacaagcaatagagtgaaaagcttaaaaaccactataggcttttaagttttactgtaatatttagtttcttaaaaactgaaaaagtggccagctgtggtggctcatgccaataatcccagttggggaggtcaagatggaaggatcacttgagcctaggagttggagaccagtctgggcaacatagtgagaccctgtctcaaaaaaaaaaaaagtgtgaaaaagctgggtgtggtggcatgcacctgtactcccagctactccaaaggctgaggcaagaggatcacttgagcccaggagttcaaggatgcagtgagctatgatggcactgttgcattctagcctgggtgacagagcaagaccccgtctctaatatatgtgtatacacacacacacacagattttttttttaagcaaaagatctaaaacaaatatggcaaaatggtaagatttgacacatttggacaatggatacctgagtgtgtgctatgttattttgtactgttggaaaagaaatgaattagctgggcatggtggcgcatgcctatcacgccagctacttgggaggctgaggcacgagaatcacttgaacccaggaggtggaggttgcagtaagccaagattgcaccactgcactccagtctgggtgacagagcgagaccctgtctcaaaaaaaaaagacagagaaaagaaaagaaatggagtctacccaattgctttttcaagatgacatgtccacgggccagtgttgcccaaaagtgaaatgcccaaaattgagctgttagtatgtgtttcagcaatgctggcataagcagatttgtttccttcaagcccctgtttactatgctaatgtttcctgtgaagtcagacaggaaagatctactgtatacaacattttccaaacctctagaccacaggcatttaaaagaattcccttaaggtaattattagcttgaaaaataatacctcccaacagaatcaaagaaactgaagacagtgaataaaaaattgaactagtatctgggagtctgatctcaaccagggacattccctcccacccccacttcaggacatttggcagtgtctggaggccttcttggttattggtatggcatcttagtgggtatggggtgaggatgctgctgagctttctatagtgcacaggagagccctccacaagaaataattatcctaccccaaatgtcagtagtgttgaggtttaaaaacccagcctagattgttgagattgtaagatttaggagaatatgtgttctcattgtttagagcagttgttaagccatttttctctttccatgtcattcacattgattgcacacctccatttaaaacctcttttgtaactttgcagtgattaggtgaatcctagagtataaaattattttgtttgttaattttttcttgaagtcttaaagggtaggcctttaagaaagattcttttagatttatagaggaaattgatataatggattcagctttccctcgttgctctgtagtactgtatacacacacatacagatacatatgtacatatccatccatatatgcagctgcctgtgtccaccaagctctactaaggcataccatacaaggcttgagggaatcataagacatggtcaactccacctctggagtattttgctgcttctgctagttcaactggaaatgactgaagaggcctgtgagactcccttcatgaataataaagcatttaactagaattcagcatttctttttggaggaggacatctgaattaagtggcaggtgaggaagagtggacaagagaaatgttgtcctgtatctaaatctgtacttaagtacaattttaaattggattattgaaactttaaattgctgtgcttttgtcttaattataattgaaatgagaatcctcatctcagaacccctctagaatataaactccaaggaaagggactttttctgttttgttcactgctgaattcccagtgcttagaatgattcttggcaggtaatagttgtgagtgagtaggtaaatgcctgaatgaaagaataaccaacttgaatgagtttcttttatgccctgagactgtagttttgttactttttgtctgtgctgtgggagacatacatacctcagctacaaagaatggcactaaaggcagatttttaagcattctgtatactgttatgccagatacagagcttgtagtattgccactttaagtgtttaaaagcaaagcatgaggagaatgacaggactgagaataggaagagacaccgagagaaaaagagaggcagttaaatcccataaaaaataaagcccggaattgcagacatgacaagtcagccttgggcaacagcgagtgaccggtcaactggaggaggagggatttgtaactgtcctgatggaagattttataatgtgttgaagaaaaaatgatcagagatgacttatactttcataactgaccactcccttttgaatcttgtgcatatcctttaacactatacctcttcaggtatatctaacagagatccattttgatagatgtgttcatagtatgcagagtattatgtacagttttggcaggttaaattgcctaaggtcacgatataaccactgatagaaaatagtatgtcaccatggacctgagagttatgttggtttattaaacaatttttttttaattaccatattgctgtttacttcactttttttttttttttttttttttgagacgtagtcttgctctttcacccaggctagagtgcagtggcacaatctcggctcactgcaagcttcgcctcccgggttcaagccattctcctgcctcagcctcccgaatagctgggactacaggcgcccgccaccacgcccagctaattttttgtatttttagtagagactgggtttcaccatgttagccaagatggtctcaatctcctgacctcgtgatccacccgcctcagcttcccaaagtgctgggattacaggcgtgagccactgcacccggcctatttacttcacatttaagagcaaactgtccttggccaggagtagtgacacatgcctataatcccagctactcaggagacaggtactcaggagacagatgggaggatcacttgagccccgaagtttgagactagccttggcaacatagggagacactgtctccaaaaaaaaaaaaaaaaaaaaaaaattttaaagtaaactatcctctagaaaccagagttttagagttagcacagaggtgccatttgcttacattatcctattcattacaaatactttacttcagactagcacatgatttgggggcaaaactactgctgggccatgggttgccattaacatctttatgttctgagacagcattgaaaatcctgaacatgccaagccaaggccaggacttaccattccattttcatttctgtttgattaccataattactacactgctgacaacccttgatgattctctagaatttgatccttttggggataagcatgtccaccctcaatactaacaaatatgtcagcagtataggccctgttgcttgaagaaaattactacctgatgctgacaacattcatatctaagattgctgagtgacctgtatgtggatgggtctctttacactaatgccacattgttagtttactactgtgtaaaaataaaaagctaggtgctttctagtgaattcagcttatcaagcagccttcctaaaacattctcaccgactcccttgctccctgagaaaaagaaacccgtcccgaacaacccatttaaacacacacattttagtgctgatcatggactgttaagtgaaaattgcagttgtctaaatagatccttttcccactgtcacatacctttcattcttgctattatccatgatcatatttgcatgcatctgccttgtccactgttgtgtctctgaaaaatcatagtttgaagccctgactcttactataattacattaggaggtgggtggggggcagtaactaggtttagttgaggtcatgagggtggagcccacacaatgggattagtgcccttggaagaggaaacacctgagctgtttctctccctgtcatgtaaggatacagtgagaagtcagccatttacgagccaggaagagggtcctcaccaagaacttaatctgccagtacattgattttggacttcgcagctttcagtactatgagaaataaacttccattgtttaagccacccagtctatggtattttgttatagcagcccaagcagattaaggtatccactcttcatgttctgttccaactaaccaatctcagtgggtctcttgaccacccagtgtccagcagacaacaagtgctcacttacagccctgtcaaatttaccatcccctaaggacaaaaaaaaaaaaaaaagaaaatcaccatgaatcactattctcagaggatatgttctcactggcccctttccatatttccacagccctgttaaccatccccagagggtattaagatcatattccaaaacaagtcttcaaggagctgtatagctaggtattcattcattcagagatacatttttgtaaatctgtagtcattctgctagttattcagttttaatacttccatgtgaatatatctgaaaagtttatgcatgattacatgttctttatgccccaattcatgtgaaattcctcttgaccattattttgggatagcagacttttgtttctcttgcattttgtgattttctctttattgcttagtgagctaactttgctttatcctttctttgatagctatgttattacaatatacgttactcttaatgtttaatcataggcctgtcaaatgaagtgtttaatatagccatactagttgtttattgggcccttactgtgtgtcagccactatttgcttttccttagatacctcatttgatcctcccaataacacctcctaagagataggtataatacctcaccccatttttgaaatagaggtttggggaaactgagtgacttggccaaagtcacatggcagagctgggattgtgactatgtccagagctcccttttcaccagctattttatcatgttccttaatctacagtcattttggaatatctcattctgcaggtgtaggggctgaggttcagtgaggtaacttgctcaaatttacatagtagattaaagagctgggattcagtttctgattttgtgactcatattccagcactctttcgatttcagttacagcttatttatctgtggcttattaaagtgcttccatgctgaatgctcaagctgccctctcagatggacatagaggctgtacctcccttgttttagatgacaaaactgaaacttggattaaaagaattgcctttgtttatatagcaagtaagcaaaacttttgatacttaacccagctcttctaaaatagtcttccctgcacttctcaccatatggcagtggcttagattttcatattgtttgttgtcctcatttctctcttttctacacagtaaatctgtaatgtaggaaacttctctttagagatgatagattgtgggccggactattattttcttgtcagtcagttatacacttaatgtcaatacagatgatggaggtaaatatgccaagatgctggctaggattttgtggctggtttaacttatgttcctataaagcagcaaattggatataactgctgatgtttagaacctttagttctaaaatctaatgtcatgttggtgctcttgtatgccaacctgcttttgaatatacttcttggttctcttttgtatttcttagtccattattgtgtattctgggtcttatataagagaaggtagaatcaacttttggcttttgctttggaaaactcttgctttcatgtagcatttcttttcttgaaggctgacttgtgtgactttagaataggcctgactgtgaaattatctatagttgcttgcatttatgtagcctaaatttggagttaaggatacagtagccttttctctggttgtctaaaaaattatctgaaaatgttcccctcttcctaagataatgtctcctgctgaaaggaaatatgcagtgtaacacatggttgattattactggatctgttaaatgatctttcatacatcgtagggaatacattggagagtgtgccatcagttctagtacaaatattctagcatcatcatcgtcagttctcaggaagtttctctagccatccagccttgatcaacagctgaccaagtgcattctggttgataacattaattattttgtgagtatggatgcagtgtacccagttttcacaaagatcttctgttatacctagggcaaagaccatacatacatttcagaactttgggagccactttgtcatcccagaaaaactgttgtatcatattatgaaatagctgttcaaaatggtgctcagagggatgtcatctgtaaattagaatattttagtagaatccctgctgcagtctactgtctttatattctaaatatgttcataagaatgtctctgtgtttggttacaagtaaccttgagctattacaactattagaaaacaattattattggatttggatggaaaccttgtaaggatcttgcttccaaacttttggagaactagtatattctcatggcacataagcaataagcagtaaacatactatatttatagtcaaggtaagtgctaacattatgacattccccaatgaaaagatatctcaaaaatcccccagtatcccaacttctgcataaatacaataaggatctcacctacaacagttttgcgataaccagcaaattctcccttgtcttatgtcatttttgtgtgttctattaaaccaaaatacttattacaacggtacttcttaaaaaaagaagtaataactctacacagttttttttttttttaaataaggtctagataagttcagagttatagttgcaatgatatgacaagggtttccatgttagctagtagcatggctaaaaaagagtacatttatatgagaggaatgtgtgtcttttctaaataaaatttaagacatattactgttgaatcatgaaatgcctgaagctatattgtttgcctcttatagaatgcttacctgtggttcagtcagcattatttcatacaataaagcaaacagatatttttaatgtctttaagtaatcttgttgattttttttattttcctgtctggatgtagctgaaagtacccatggcagacaagcctggtaacacagtgaatttccggaagctgctactgaaccgttgccagaaggagtttgaaaaagataaagcagatgatgatgtctttgagaagaagcagaaagaacttgaggctgccagtgctgtaagtattttcatagaaagacagtgcttgtacactttgagcactgtaaagtagaaatttcaggaagctagatacagcatctccctgctaccttaagagggacctatggcctttttttttccatgtagaaacaacatattaatgtttaggggaatgctttgttccttttagtgcctaatataggggacagctaaattttccatgccagccattcaatctaagcctgagtcaggtcactgagttccaaaaatctgaaatggatgggtatagttcagttttctgagcagtagattctacacttgctatcagattctcacggggattctgaccccatgaatctcagtgtttattgtgcagtacaactttcatcatcaagatgctattattcctccttacacaacagccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaaggtaaaaatccaaaagctcagaaaccttcgcaaaggctccttgtcagttgcaaaagaacttagactgtcaacagaatagttctatcttttcccaaaggtctgggctgtttatttttcttcttttgcccgtctcattgtcagtgttcaaccatcgtgctccttacatttccatcagagtcagagatgaggagggtcccaaattgtgtaaaagccagtttgtagattcttcagattatttgtcccatattcttttttcttcttctgtaaccatttcccaatttgggaacagaaatatgcaaagaaaaactatggcctaagggtagtgcagaaatgaagacccagtagtgcttctagagtttatactctaattgatgacacagccatctaaccataatataagaaatcattaaaaatactgtaataatgtatgctatttaaggggtatagaaattagaaatgcttcaaagaaataatgtcagaaacgctccataacatctgattcagctaggattatgcttagctgtgacagaaaacccagtggtttatacaagattgaggtttacttcttatttatgtaaacaaagctctgaggtaagtcctttcagcttaacattctgtgactcctaaagtttaacccttgtcctaattattctcaccagagaaggtaggaaaaggggcaaaagacacagccacctctctctctctctcttttttttttttaagtaacagggtcagccgggcacggtggctcatgcttgtaatcccagcactttgggaggctgaggcgggcagatcacctgaggtcaggagttcgtgaccagcctgaccaacatggagaaatcccgtctctactaaaaatacagaattagccaggcatggtggcgcatgcctgtaatcccagctacttgggaggctgaggcaggagaattgcttgaacccgggaggcagaggttgcagtgagccaagattgcgccatcgcactccaggctgggcaacaagagtgaaactccatctgaaaaaaaaaaaaaaaggaaaaaaaaaaaaaaggtaacagggtcttgccctgtcacccaattttttttttttttttttttttttactttttgtagagatgatgggtctcacttagttgcctaggctggtcttaaactcctggcttcaagcagtccttttgccttggcctccctaattgctaggattacaggtatcagtcactatgcctggcccctctggtctctttaggaaggccctaggaagctatagcataacatttccatttatattattgcctatcattaatcacgtgaccaaagccagctgccaggagcctagaaaaatgtagtctttattttaggtggtcatatgaacaactaaaaattctaccatatggccgggcacagtggctcacacctataatcctaatactttgggaggctgaggcagaaggattgtttgagctcagcagtttgagaccagcctgggtaacatagtgagatttcctatgtccaaaaaatcatacacacagaaaaatttagctgggtgtagtggcatatgcctgtctgtggtcccagctacttgggaagctgaggcaggaggatcacttaagcccaggagattgaggctgcaatgaggcataattgagccattgcactcccaactgggtgacagaacaagaccctgtctcaaaaaaatacaaataaaaattctaccacattatattttggctataaattgatattcctagaccatttagaaaactacatgggctggacgcagtggctaatgcctgaaattccagcacgttgagaggccaaggctggaggattgcttgagcccaggagttcaagaccagcctgagcaacataatgagaccctgtctctacaaaaaattaaaagattagccaggcacggtggcacgtgcctgtagtcccagctactcgagaggctgaggtgggatcggttgagcctgagaggttgaagctgcagtgagccgtgattgtgctactgcactccagcctgggcaacggagtgaaaccccatctctaaaaaaataaatagataactacataaataaataactgtaaattggtaaaattacgtttaagtttctcagacaggagtactaatgattttgtctcttgcagccacgtatggaccagtactttaatcagatggagaaaattgtgaaagaaagaaaaacctcatctaggattcggttcatgcttcaagatgttatagacctaaggctggtgagtgggaaaaaaaataataataagcctgctggtccagtctctttaaaggaattgggttggggaaggatgtcctgttgtttacatgtgtaaagatagtgcttttgcttcaggactcagaatttggattggcaaactttccgtgggagagttctgagaagggacaaaaggcctattgccagttacgtgcttcttctccttattctgattatcaaaccatattgcaattttgtttgcgctttgtttttttttttgagatagagtctcactctgtcgcccaggctggagtgcagtggctcaatctcggctcactgcagcctccgcctcccaggttcagatgattcttctgcctcagcctctggaatagctgggattacaggcacatgcccccacacctgggcaatttttgtatttttagtagagacaggatttcacgctgttggccaggctggtctggaactcctgacctcaaatgatctgcccacctcagcctcccaaagtgctgggattacaggcgtgagccaccacgcccagccacttgcaatttgtaatcagccattctgaattcaaactccattcaaatgtaaattcaattaaatttagtctttgtgagctaaataatcagcaagtctcatctccacagtaaatacctttaactctctgagccttacatttttaatctctaaaatgaggatgttgcctaccttgcagatttgttgaagagtcaatggaataattacgtaaggtgcccagctcagatattggtgttttcttctctttcgtttttcctgtgaccctcctattctgctgctgggttttttttgtttttttgtttttttgtttttctcatttctcttaccgggtgcagtttttgttactactacttttctctgttttaagtttaactcctacagggagttactcttttgtaagtttcactcctacagggaatatactacatcaagccctacactagagaaagtgaacaaagccctacctcttatttctcctccacccaggccagatagcattgatgatgattctttatcttgctaagactagatgtggttgtcttcacccatgttatcaaccacttatatcagatgttgggactgttgctagaaagagaagggagaagtataaagtgacaacttattttgtccttaatacaggggataaccaaagggcagagtggtatggacctttgtgtagaatatcagaaccatgatattggagaaataaaagcatgagtcatccttgacttagaacccctatggaatgtgatatgatctgagtagtaatcccacagattaaggcaaggccaaggaatcctcatcatttttatttttctctcctcctttcaaatgtacaaaatactgatacagataaaatccatttagtccacagagaaatatatgccatgcttaaaaatataataataaatttgggccagtctttcaccctgttctttgtatccattggctattggaatatgtagtatacaattggccagttttgactgagaagattttaatccttcagctctaatcctaaactgctcatagtgtcatctataagatacatgagaaactgccataatacagcttttgtaggtattttgtacttttccagtagtaaaaattgctaatttttaaattttaaaaaatgttcagtttatctggcagataaccttattttctgcttttatagtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgaggccggaatccaccagggtttagagaacttggaagtttcaggaatacatattaagaattatgtatttaggtataaaatgagatcagaaagaacagcccaaagaatagagtggtgattgttaggtgaagcagtttcacctgaagagtaaagttactgagtaaaagtagagaatgcaggaacaaagcatgatttctttcactacttaaaagccagtaagcaataagactttattgagcatcttctatatactcagaattggtgagacgagaaaaggaagtggaaaatgtagttacttccctctcaaagtgtacagtttatctggtaaggtaaaacttttgacaagcaaaagaggaacatttgttaagcaaatggaagatagtatatcaattatgaaatgtgttctccattaactgttaaaatttagagaaaaagaagagagacagaaagctgaaagaaaactttatttaagaaaggggcactttgtagcaggccggacgcagtggctcatgcctgtaatcccagcacttcgggaggctgaggtgggtggatcaattgaggtcaggagtttgagaccagcctgaccaacatgatgaaaccccgtctctactaaaaaatttgctggacatagtgatgtgtgcctgtagtcccagctattcaggaggttgaggcagaagaatcacttgaacctgggaggtggaggttgcggtgagccgcgatcgcgccactgcactccagcctggggaacagagtgagactacatctcaaaacaaaacaaaacaaaaatagagacatgcaaaaaaagtgaaagatgaagtagaaggcattttaaacctgagacgatagtccatttactaagtttaggaacgttggaaaagaaaacctttttcagagggaaatgataattttctggctgatagtaaatactcagtaaccattagttattgtcacagacacagtagagctcatagtgaagttgttaggagagatgaattctgcatggaagaaagtttacttttaagtttcttgagataccacacttaccttcctcgctctagtacctagtgcagtgccttttgggtaataacttttatttattattgaaccagattgagagggaaaaggagaagataccaaagcctaattcatggaggatattcacatatgactaaaggaagaaaagaactcttggaaaagtgccagacaagtggagagaaaggactaagatacaagtgtcatagagacaaggaagaagcaagtctgtttatgatcagtaatatcagatagcacggagaaaatcaagacgttatgttaggaccagaaaagcttttggatagacagttcggtgatctttcaatttattaattcattcagcaagtatttttttttgagatgagtctcgctctgtcgcccaggctggagtgcagtagcgcgatctcggctcactgcaacctccgcctcccggattcaagcagttctctgcctcagcctcccgagtggctgggattacaggcgcccaccaccacgcctggctaatttttttgtatttttagtagagacagggtttcaccatcttggccaggctggtgttgaactcctgaccttgtgatccacctgcctcggcctcccaaagtgctgggattacaggcgtgagccaccgcacacggccctcattcagcaagtatttattgtctgtcacttaacaaggcactcaaagtcccttccatcatgcggcttacatcttatggtagaggggagagaggagacaataaataataaatacttaaataaaatatatcatttgtcaaataaatttgtagaaaaacaaagaagggagaagggactagggagtgcaaatcttggtgagtagggtgcagttttaaacaggaaaactggggaaactataaaagttggtattgtttgagcaaagacctgaagcaagtgagggtgttaaatcatgtggaaatctggggaaagagacttttaggcaaagggagtagtaagtacaaagaccctgaagcagcattttcaaggaatagcaagggggccagtgcagctgaacctaagaagggcctgacggggagagtggtagaagatggggacttagaggcagcaggagccagattatttagaggccatttgtaaggaatcttctctttttctctgaatgagacagaaaggtatcagaagtgttttgaacaaaaaagtgacgaattttgtactttactaggatcacactggctgccatgatgagcacagctgaaggtagaagcaggaaggccaaaacacgtctctgcagtaatctaggaaaggggtgttggtggcttaaacaaaactgctaatgttggtagtagattctgaatgtattgtataggtttaactggcaaggtttactgacaaaaattggatgtgaagtgtgaaagaggagtcaaggttttccacctgtgcagctgaaatgttggagaagcagatttgggaaataaagcatacttctgtcatttgatcccattaaatacaatatactttagaataaataatttccatctgacttctccgaaagtgttctagtcattaattctgtgaatactggatttagccctgccttctccagcaccaggtattcatttgtgtcagttgtttgtttctaggtcagtaatgtttcatgggtgatccaaaataagcagtgcttctgctgatacagggtgcttctgctgatacagggtgcttctgcttatattttcctgccatgggattaaagatattgtcatcaatgctttaacatcttctgttgtctttctccttggttttgatgaaaatattgctcactctttcaatgtaaaactgacttgagacagatgagagactcccactctgttctccctgcaggtgtccagagagtggacgaaggtgggtggaacactgtacaaggggccaagaacagtcgggtactggacccctcaaaattcctaaaaatcactaaggtgagtctgacatttaaagtacaatttacgctctcctttgatgcctttgatattaaaacacacacacacacacacaatttacaatagttgcaaaacgtgtctcaaaagtacttattaaagtaaaacagcaatattgcaaatccatggggtggttattttttaatgcatttttcttcaagttactattgatcaatgtattctacaaactcatttctacattttctttttttttttttttttgagatggagtctcactctgtcgcccaggctggagtgcagtggcacgatcttggctcactgcaggctccacctcccgagttcacaacattctcatgcctcagcctcccaagtagctgggactacaggtgcccgtcaccacacccggctaattttttgtattttttagtagagacggggtttcaccgtgttagccaggatggtctcgatctcctgaccttgtgatccacccacctcggcctcccaaagtgctgggattacaggcgtgagccaccgcgcccggcctcatttctacttctataaggatttactaaagaggaaaagactaggttacttcttagacataagatgcttaatatacaagaggtaataacaaagatattttagaagcctaagtcaattgcaggcttttacacaatgtatccgtagctctggggaaaaaagcaatcacctgtttaaacctaaccatgaaagatttgccttatccaaggcgtaaaggaaaccacagagggcctactagaaatcattctgtaataaggatttaagagactctgtctgctttcctctctttttgagagtctgtgggcagtaagaggaaaaaactttctgtagcaggtattttcagcagtaaaagttgatcattgtaaggaggatgaagaactttggagaatgtagagaaagcagaattaaatatgataagagtggaaacttctaaagtccagtgggttttccaaatcatttgcaagtctagtttgatccttatacttcccatagttctgaaaatcggcaccctgctagcaaaatactgaagacaatcaaaactaatgtgaaaatactacatgaaagaagataactgacaagaagtattaagaaaagtctttaagaaaattggaataaaatgggctatgtcatttgcatcttcacagttttgtcaaagctttgcttcatgatagaaaattctccttctgaatctctcttaataatgtaattagctaggatccttttctccaagattctggtactttcttctagttgtttatatctcagagtaggaattccattgctgaatacaatttgagtcttacccatctccatttccatctagagacagttttaactaaaagtttatgtttaaagaagtcctccagcattttgaaaaatgtgtcggtatttaataacaacatttgtatttttaaatattatgctttccgtgcttggatactataaaaacagtgctggtatcaaacctccaacattactaccttaatatttttaagtatgtaaattgctaataaactttgtgtattcagatagttatactggaggtactatacatgggtatcctagaacaaaaccgttatacatatttattgttaattgggagtggtttgtgtgaaagcatattacatagcatagcaacatatatattatgagctgtcagaccatagaaataccttttttacaaagcgctacattacagcttttatgttatatgtattttataataatatgcattacagcgtaattttatttcacttgtagtaaagttgtgcttggaagattaaacatgagatatcaggcaccttaacttcctgtgctccctgcctaacattccaatctctttcttcttattctttattgaatactcacatcccactgcctgtctctagccaacatgaaatttttatgtctgttgatctgttttctgacagtcatgtaaagacactaatgaattaattttgtagtatttgtattttttatttttaaaattaatgggtattgtacaagaagaatgattagaaactgcttattacagttagcaaattcataaaccatcttaaacaggaggacctggatgcattctctagaccaaacagttttttgtggaaactggagtccagggaagtgcttcaggggccacatggatcccagtttaatgagaacagctccaatttctgtttctattaaattggcattccaaacaaatttttgttgctaaaattggttctacttcactgaagaagaaaaaaataaaagaaaaactattcttctagaatatttcctataattgacttgtggtcccttatgttacagcctacaattgatgaaaaaattcagctggtacctaaagcacagctaggcagctggggaaaaggcagcagtggtggagcaaaggcaagtgagactggtaagtgtgtgtgtcccttctcaaacctggctgtggcttgttagcatttgccttacagcgcattcccatagtcatcgaatgatggtttttgggaaagatgtgtagactaatcatgcctaaaattttattggtagccctttcctttcaacatagatcctttctcaggatccttaaataattttaagtatttttttaatttcaattcattcatttagactatttaattaagacctttatttatttatttatttatttatttatttatatatttttgagatgggatcccgctctgtcacccaggctggagtgtagtggcatgatcacaactcaccacagcctcaaccacctaggttcaagcaatcttcctgcctcagtctcctgagtagctgggactacaggtgcacgccatcacacctggctgatttttttttttttttttaattttttgtagagatggagtctcactgtgttgcctaggctagtcttgcactcgtgggctgcagtgatcctcccaccttggcctcctgcgtgctgggattacagttatgagccacactcagccactaagaccttaattttttaggttccctttttgttgttgttcacaaatttaatatagctagagaaattactgggaccctaaattaaaagggaaactcattatgctgataaaagaatcttaatatgcagagcatttactataattttagggagctgtaaaagaataaagaaacattgttcaaaatctttttcgaaaatcagattttgagagatttgacctcaggaccaaagatgtttggatctcacaaacacatcttactagcttgaggaagcccaatggaaagaaaaaaaatttaatgttaacctacttcctatatgtcccttctactaagtaatttcaacctttttttctttaaattttaaaaaatgtcattattcagtaaaacccacatgcatatttgtgcacaaatgagattggagcatttgtgctggttagctttgttaaagttttgttctgttttcgcttgccttcctcctcctatatgccactcccacccctgtttactatgtttttaaaggaaccaatggttgaaataaataaagacttctaaactctattatgtgcaaattccctctaacactttgcttctcagaatatggtagagggaccaggagatgggcgtcacctaagcttgttaggaatgcctggtctcaggcctcacctagggatgcagatgactgattatttgcattttagtcatgtgatttgtatttttttctaaatcctcgacatgtgtagatgccttacggtcaagtgcttccagtttaaacagattctctgccctgcaacctccagcaccctcagggtccacgccatccacgcctgtagagtttgattcccgaaggaccttaactaggtgagaaccctgctttttatgtctactcaaggctggcccgcttgccagtatgtgtggcaagataagaacaagggttttgatagcaatccttatggatgcattccttttattcctaaagttgatttctttaatcttcacacactataatttctaagataggaacataattgggtggtgaatttgggatgggatgggagggaagggattcttaagaaagctaggcccacccaaacagccctggaggcatgtctaggggctccgcaagctaatcctccagatgttctagaagcacctagcattctcaaccatgggaattaaagaacatgacaatccacccatacatttctctgtcacactcttcatgttatatttgaggttgtccttcagtttttgctagtctccatatttcactatctttctgcttttgcttttctaggattgatacagtcaagtatcctgttggctggtttacataaaatgaatgggcaccctgtagtgcagtcacaaaaaataacattttttacataagcactttcagaattgaagtttctttaagctctaaaactttttttttttaattattattttttagagatggcatcttgctatgttgcccaggctggcattgaactcctggtctcaagcgatgctcccatcaggctttttattattattattgtaataagtttgattaggtagactttgtaaactgtgttcttattcccttgacttctattgaaacaaagtatagttagcacaaggcagcttttcatgatgattcaggttgtcattgagtatcacttgtggcgctttgccctgtcataaatgtcccctaatggttctgcttcctaagcacttgtgtatgttctttcacaatagttagaccattttcctgcccgagtctctccttttcccttttaatttgctgcttctggtctgccacgggccaacgaactgtttgctcagctggttagaattgtctaaaagaagacgaatcaggaaatatggagagtctctcttaaaaggaataaaatatatagcgttggctaatccaagacagcttcttcttgattctcaaatattttccatatgtttaaagattctaaataaaaaggtatcattgcataatttctgagatagtgataccatgttcttataatatttgtttccctttcatttatgtaactcatactttatcattgtcttctttattcctgaaagattttttaaaactaaaaaaagaaattgccaaaattaaggccgggcacagtggctcacgcctgtaatcccagcagtttgggaggccgaggtgggcagatcacctgagatcgggagttcgagaccagcctgaccaacatggagaaaccctgtctgtaatcccagctactcaggaggttgaggcaagagaatcacttgaacccgtaggcggaggttgcagtgagccgagattacgccattgcactccagcctgggcaacaagagtaaaactccatctcaaaaaagaaaagagaaagaaattaccaaaattatcactggctttttttgagacagagtctcactgtcacccaggctagagtgcagtggcgcaatcttggctcactgctacttcctcctcgcagtttcaggccagtctcatgcctcagcctcccaagtagctgggattacaggcacccgccaccaaacccggctaatttttgtatttttagtagaaacacagtttcaccatgttggccaggctggtcttgaactcctgacctcaagtaatctgccctgctcggcctcccaaagcgctgggattacaggtgtgagccaccatgcctggccaccactgacatgttaaagtgttaaatagtatcccttcagagaaaaaagttaaaacatcttaataaatattccctttaaagcactcttttacttgtttgttgaataaactttgaaatataattggtgcctcacacatctaatgttatctgtgaaaaattctgtatactttcagaaagtcttagtgttattttataatttgaatatgtgggggacatgggcttgtctttcctttgaaaagtgttgttttgtcttttaagtcgtggaagtatgggcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcaggtgagagacttggcttaaacagatgcagatttgggttttaaatttggaaggaaaaataaaaaagagactgtgcctgagtagattttagaattaacacataatagcaacacataccagcatctgaagagttaaagggtacttcatagttttataacagttctcattccctaggtatgccttagctgaacagtttgtaaattttctcctttctctattaaatgttatggtgaggaggtcctcctgctgtattttaagcaatctgaatttcttacaagtccctgtaacatcccacacttgacgttgctgttagattgtgtatgctgtgtagagctcctcaaatgtgtgaaaattctcattgagccactgcaagacaaaccaaagagaaggtattaggttatctttagctgacttcatcttccgtggtaacctgttgtttttgtatgcatttagcatgtatatacttagaggacttgctcggataatgctctaaaaattgcttcatgtatttaacctgtgtttcagtttccttatctgttaaatggggataagttgtacctaccttttcaggatattatgaaaattaaataagaagttaatacacgtaaacacttagaacattacgtgataaatacaaggttttcaaaaagtattaaatgttgtgatgacgaatatagcaatggaaaacagtttaaattgaagattattttcagcctcttttaaatattagtcatgaagtaatagcagttttagttttttagtatttatatagctttctaatttgtttcactatataaattgtatctcttaactgtagtccctaaatggatctcagagacaaattgaagtgtcttctcccaattggtgtaactttagataatacagctttagggacatatggcttttttaaaatctgtgctagatacttttgaaatataacaggataggacataaaatatcttgggtgtaatgaataatgtagcacagctgccctatgtgtttttattgtctggttcatttgtacacttaccagatgcacagtgaatgtgaggcccttgatccctgttctcggccttcagtctgctgagtcagaaagaccttttttagtaattccacgaaagacacaaactgagaaaggtgctatgaaggaaggaatttagttctaagagaatacttagaactatctggtaccaaggagctatgtagaataggggcaaggggaggtttccttcatccgaaggaccagtaggaatgaaacaggttcgtaggcaaggatgggtgtgaaacagagggaaagagcactccagacaggattactgtgagcagagctgtagtaggaatagccacggtttgttcaagcagctgcccaagatcagtgtggctcaagcttagtggcgagcagggccctgacctgtgcaggattgtgaagacctcatgtactcttcatctttgaagcaatggggagcaatcataatacagaaaggaacaaaaaagctttaattaggaaagtttatcatgttcctaaatcttgttcattgttattgtagattataaagttacttagtgcgaatctattctaaaacaaaaggtttctgtattctgtttttatctattaaatgtcttgtagctattaaaataatgtaatagcacataatattgtcaaccataatctcactattttaatagtaatttttattatttttactttttttggggggcctcactaatagcaaaaccagaaatttcagcaatgtcagctcatgacaaggctgcattatcagaagaggaactggagaggaagtcgaaatctatcattgatgaatttctacacattaatgattttaaggtaaatgagattaaaaaaaaaacacacacacagtaagtcctttgatagtatagaataacttggttctggtctaaatcaggtgtcattgtgaactgataagacttaggttgagtaatacaagtcctacacaattcagtttgcttaacgctgatgcatttctgccaagtactctcttttaatttgatactataatttacaacatagagtggtgggcagagagtatgagtaccaatccatccccactaagggaaaaccaaattgatttctatattaaggaacaaaaacaacacattatcattatgaagcatttctggcaccctgtatatagctgtcatggtctttttttttttttttttttttttttttttgagacagagtcttgctgtgttgcccaggctggagtgcagtggcacgatctcggctcactgcaacctccgcctcccaagttcaagcaattctcctacctcatcctcctaagtagctgggactacaggtgcccgtcaccatgctgagctaatttttgtatttttagtagaggcggggtttcaccattttggccaggctggtcttgaactcctgacctcaaatgatcacccacctcggactcccaaagtgctgagattacaggcgtgagccaccacacctggcctgtcatggtctttataatcattctgttatcattctcatattaatcttgaaatatggccagcattactttttctttatttcataaaactgaggcataaagaaacaagcaatgtgccaggtcagacagcctaagccagagatttcaagacaaggccttgaatttgccctttaacccttaccttctctttaatcttcattttgagatagtagtgaataagacatttctacctgaccttgtgaaccctatagtctagtggcagagacaaaccataaacaaataactccactagcagttacttaactgtagttatgataaatgctagtagacctataggtcttaggagaaatccattaatgggatctgattaagtgatgtgaggtcaggaaaggctaatctgttaaaacagtcttatctgttaaagtatttgtcagatatattaactacttttgctgctttggcactatattattaaaaattctttcaagattatttgttttcttggccgggtgcagtgactcatgcctgtaatcccagcaccttgggagctgaggcaggaggatcacttaagctcaagagtttgagaccagcctgggcaacatgataaagccccatctctacaaaaaatacaaaaattagccaggtgtggtggcacgcatctgtagtcccagctactcaggaggctgagatgggaggatcacttgaagcccgggaggcagaggttgcagtgagccgagatcatccactgcattccatcctgggtgacagagtgagactgtctcaaacaaacaaaaaaaaagaaaatattacttgttttcttaacagtgtaatcatcatctgctttccacatataaaaatcaccttggttatctatagttcaatcttctaaagccttcaagcctctgaaattcttcaaaattcagaagaagtagaaggaagtttttgatgatgagtgaggtggaggtgagtgctttgcagaaactgttggaaatgtaccaaagtaaatgaacattaacgggaaatagccaaagaataaacctgatgtactgtgattcatcagttagcctcctggaaaattaggggtattcttataaattggcagcatagcctttttcttgcatggaagtagggaaatgtgaacgaattgcaaaaaaattagaatggccaagaaagatgaaacgccaagacagtaaggaagaaaacagtggagattggcttcagatgtaatttgaaggatgtacaaagtcaatgaataaccctttaaaaggggaaaaatatgatcctgtgatgaactggaggtatagggagtaaaagaccttagtaacacctaaagagtacaataggaggactctttggagaatcatgagccctgggccaggcttgcaatacagaaggggcagaatcgttgtatctttagaatttcattgtgcagtgtacaaagcaactgtgcctgcaatatggttaaaacaggtattaacattgggcatttactgaggacttactctgcgttgggtgctgttgtacatattcggcatgtattagtttgtattgtcctcgtaacattctcctgaagttgatgttattatcatacccatttttcagataaggaaactgaggtgcaaagatgtaaatcaacttgttcaaaatcttaactgctaataagtgccagattgaggattcaaagctaagtttctagcttcagaggagaaaatgctttatctcattacctttggggtattagtgtgtcaggctaaagacttaaagagctgatcttaaaaatattttttccaaatatcttcctattaggtgctattgtttttaacagtgattcaaattaatatttattgagggtttattttgtgcctggcactgtgccaagttcttatacctatattttatatacattcctcacggtaactctaaaaagttaagcccaagagattaagttaaactcctaaactctaaagtagtaagtggcagagccagggttcaaatgcacctctgtctgaccccaccgtgcatgttttagcctctatgctatttatttattgaatacctaagtgtgctagccacattttaggggttatgactgggtataccatatttgtagtgaacaacaaaatctgcttccatggagcttacattccagtggggagatacagacaagtctggccctaaagataggtagtaaattaataaataaacagtagctaccaaaaaaatgttttcagtgccaaaaactaaaattatgtgatttgatggagtcagggaagacaggaagtatcatttcaactaaaagctcaaagacaaaaagaagcaaaccataagaaaaccagatggaagggcgaggttatgaactgctatgacactgtgagtataatgatatagctggaagtattacccttgaaaaccagtgcaagacaagaatgtcctctctcaccactcctattcaacatagtactggccagggtaatcaggctagagaaagaaataaagcatattcagataggaagagaggaagtcaaactctccctgtttgcagatgacatgaacctgtatctagaaaaccccatcatctcagcccaaaagcttattaagctgataagcaacttcagcaaagactcaggatacaaaatcaaagtgcaaaaatcactagcatcagtcaagctgaaagccaaatctccagtgaactcccattcacaattgccacaaaaagaataaaatacctaggaatacagctaacaagggaagtgaaggatcactacaaggagaactacaaaccactattcaaagaaatcagagatgacacaaacaactggaaaaacatcccatgcttgtggataggaagaatcactgtcatgaaaatggctatgcgacccaaagcaatttatagattcagtgctattcccattaaactcccactgacattctacaaagaactagaaaaaagtatttaaaaattcatatggaaccaaaaaaaggagcccaaatagccaaggcagtcgtaagcaaaaagaacaaaactggaggcatcacactgccctacttcaaactatatatatgtattttttttattttttatttatttattatttattttttttcttgagatggagtcttgcactgttgcccaggctggagtgcagtggcgcgatctcggctcactgcaagctccacctcctgggttcacaccattctcctgcctcagcctcccaagtagctcagactacaggcgcccgccaccatgcccggctaattttttgtacttttagtagaaacggggtttcacggtgttagccaggatggtcttgatctcctgaccttgtgatccgccctccttggcctcccaaagtgctgggattacaggcgtgagccaccgcgcccagcctacttcaaactatattacagggctacagtaaccaaaacaacgtggtgtggtacaagaacagacacatagaccagtggaacggaatagagaacccagaaataagactacacacctacaattatcttatcttcaacaaacctgacaaaaacaagcaatggggaaaggattccctttttaataaatggtattgggatacctggctagtcataagcggaaaattgaaactggagcctttctttataccatatacaaaaatcaactaaagatggattaaaatgtaaaactcaaaactatgaagaagaaaacttacacaataccattcaggacataggcacaggcaaagatttcatgatgaagatgccaaaaacagtgcaacgaaagcaaaaattgacaaatgggatctaattaaactatagagcttctgcacagcaaaataaactatcaatcaacagaataaacagacaacttacagaataggaggaaatgtttgcaatatacacatccgacaaaggttttttttgttgttgtcttttttttgtttgttttttgagatggagtgttgctcttgtcgcccaggctggagtgcagtggcgcaatcttggctcactgcaacctctgcctcccgggttcaagtgattctcctgcctcagcctcccgagtagctgggattacaggcgcccgccactacacccagctaattttttgtatttttagtagagacggggtttcgccacgttggccaggttgatctcaaactcctaacctcaggtgatccgcatcccaaatactgggattacaggcgtaagccaccatgcccggcccccgacaaaggtcttatgtgcagcatctgtaaggagcttaaacaaatttacaagaaaaaaaaaacacacactaaaaagtagacaaaggacatgaacagacagtactcaaaggaagacatacatgtggccaacaatcacaagataaaaaagctcaatatcactgattattagagaaatacaaatcaaaaccacaatgagataccatctaataccagtcagaatgactattattaaaaagtcaaaaaataataggtgttggcgaggttgtggagaaaaaggaacacttttacactgttggagggtaaattagttcaaccattgtggaagtgtggcgattcctgagagacctagagacagaaataccatttcacccagcaatcccattactgtgtatatacccaaaggaatataaattgttctcttataaagacacatgcacacgtatgttcattgtagcactattcacaatagcaaaaacatgcaatcaacctaaatgcccatcaacgatagagtggataaagaaaatgcggtacatagacaccatgaaatattatacagccatacaaaggaccaagatcctttcctttgcagggacatggatagagctggaggccattatccttagcaaactaatgcaggaacagaaaagcaaatacttcatgttctcacttataagtggaaactaaatgatgagaacacatggacacgtagaggagaaaaatgcacactggggcctactggaggacagaaggtggaaggagagagacaggatcaggaaaaataactaatggatactaggcttagtatctgggtgatgaaataatccgtacagcaaacccccatgacacacatttacctatgtagcaaagctgcacatcctgcacatgtacccctgatcttaaaagtttaaaaaatatatatcatgatatagctaattgaccctttatgcaaacacagtgaatgaattcccattagaagacatttaatcacttccatttaaatactgaggaatgatttttatttatttatttatttattttttggagacagagtctcaccgtgtcgcccaggctggagtgcagtggggtgattacagctcactgcaacctccgcctcccgggttcaagcgattttcctgtctcagcctcccgagtggctgagattacaggcgtgtgccactacacacggctaatttttgtatttttggtagacacggggttttaccttcttggccaggctggtctcatactgctgaacctcaaatgatctgcccgccttggcctcccaacgtgctgggattacaggtgtgagccaccgcttccagcctgaggattgaatatttgcattcatttacaagtcctcttgaaaaggcataacaatgatgttgattggcttaaaataaggttaaaaaacccacaaggggccaggtatggtggctcacacctgtaatcccagcacttttggaggctaaggctagaggatcacttgagcccaggaatttgagaccagcctgggcaagatatccatctttacaaaaaaatttttttaaattagccgggcatggtggcatgcctgtggtcccagctacttgggaggctgaggcgggaggattgcctgagcctgggaatttgaagcagcagtgatctataatcatgccactacactctagcctgggtaactaagtgagaccttctctctttaaaaaaaaaaaaaaactaaaagacccacaaggatgaagagaccagggaatagacagaagcaacgttctggaagttggaaataagaaggatgagtggtaatttatttaacaaactaagactgtctgtgaggtacagatgtggccagaaacaaaagggaattagttggttaaaagcatatataagaaacattttacagccgggcgcggtggctcacgcctataatcccagcattttgggaggctgaggcaggcgattacctgaggtcaggagtttgaaacctgcctggccagcatgaagaaaccttgtctctactaaaaatacaaaattagccaggcgtagtggctcatgcctataatcccagctacttgggagactgaggcaggagaatctcttgaacctgggaggcaaaggtaacagtgagccaagattacgtcattgcactccagcctgggcaacaagagtgaaactctgtctcaaaagaaaaaagaaaccattttacatgataattgtcttgaatgtttcaaaaatggcaatgtcatgaaaagacaaaaaagagaaaggacgattttagattaaaggaatctgaacaacataacatgtaaagtcgggttctcaactggactcagcaacaacaaaaagctatattagacattcagagacagttgtggaaatttgaatatgtactatatatcaaatatttttattgacattatagtaaatctcttggacattcagaaagaaaacaacaattgatgaatctaaaagtgaagatatgtagttgtatattgtatgactctttaatttttctgtaggcttgaaattttgttagataaaaagttaatgtgagggaggtattaaataaaggagcagggaggaaaaagcggcagtggtgagacacctagatgagccttctcccttctgcatcagttcatcacccttcctacctacatcctcccccttcctacctacatcctcccccttcctacctacatcctcccccttggaagagctactttgctgcaaaggttgaaccaaaagattgtgaattcagggcaccagactaatttccagtagctgagaacagagagatacactgctttattggtgtatcagcaactctggctgaccgactttcacccttcagaccaaagatattgacttggctggatactctatagtaaacaccagttaacaagcacaaattaagaagcataccacaagaacttactaaaagaattttaatgcttaacctaaccatatcacttaaatttaactttcatatgaaggaagacctttttcattgaagattgtgcaaatattaacctacacagacacagtaacctctgttgacacattaaggcttttgaatcatgacattaaatttctatttcataatataccattttcaattttttaaatcagtgatcataaaataagtaaatattatgtagaaaaatacatttgactcaccctttgagtgatgtttaataaaattgttaaactaaacatgttagctttgtaaagatgcatcattataaaattttttttatttataaaaacagttctctggtaaaaactggaaaacctactagataaatttgaaaagggctgtaatgctctttttttgtatgacttttaatattgcccatatcagcctgtaatttactgagctataaattatgttaaacaaatataaacttatatttgaaaactgtcctgttcatggaagtttctactgattctgttgtaagtaaaagattttaaagttatcttaacattctggtaacactattcagattttggagtaaacctttctttgctgttggaacaggaagccatgcagtgtgtggaagagctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaagggtcagtatcctcttcaagagtggtattcagttactaggctcttgggtaccagttaattttcaaagtacttacctctttaagtatttagttttttccatagatgaaaattgtatccactgtaatatgttgatatgatgcaattaatatattgatatgttggttgatgtgatggcattttatagattgtgctagggcataaaggttatcttttggttttctgaatattattgttagatctctatcatgatgtaagtaaggtaacagagaccccttagcctcagggaaactctgaggcctttagcagcccatttacatgtgatccccaaatgttctttgaggaaaaaagcttttctttgtgagaacaattctgaaaaattgtcttaaatttaaaaaccatattctttcaataaaccatggttattgtggctaggaagcacttgtgtgcccactctagcctcatggagaaggttatgtaacttggtgttcttaatgatttagtctatttcaggttggtttcattatgattcttgtcaatggatggtttgataaggtctgcctatctgcctgtcactggtggtgaatcctcatttgatcaggttctggtatatttgtgatataccatcatcacaagtacatggatcaggttccttgtggttcagccacaaaatcttacccaggcatagggtgtataaccaatgtttaaagtgaaatttgcattggtaaaaaattttgttttaggagccatgttgtatcaaatataaacacagagtcacacccagcactgacagatgcccactctctaagggaatagcaactaggatctcctaaggtctggacattggattaacatctgccatctcatcctcacctggacatatgcttattgaatcaaatggcagtaagaattctgtactacttgtaattttcctcttttttttttttttttgccaagctcatgttctcataaattaaatgcacatatgattaaatgccactgtatatttttccgtagtcatttcacatatggcaatccttttagaataaggtaaccattaaatgtcattgttggccaggtgcagtggctcacacctgtaatcccagcactttgggaggctgaggcgggtggatcacttgagatcaggagtctgaaaccagccacggccaacatgccaacatctactaaaaatacaaaaattagcccaacgtggtggcgtgagcctgcaatcccagctacttgcgaggctgaggcataagaatcgcttgaacccgggaggcagaggttgcagtgagccaaggttgcaccactgcactccgcctgtctcagtctctaaaaaacaaaaaagtcattgttgaatttattcgtttgactttgcaagcaatgacagcgttgtcttctaggtcctagaaaatttatacttgcccctaggaccattaaaaagttttcttgccaggcgtggtgactcacgcctgtaatcccagtattttgggaggccgaggtgggcagatcacgaggtcaggagttcgagaccagcctgaacaacgtggtgaaaccccgtctctactaaaaatatgaaaattaggctgggcaccgtagctcacacctgtaatcccagcactttgggaggccgaggcgggtggatcacaaggtcaggagatcgagaccatcctggctaacatggtgaaaccccgcctctactaaaaatacaaaaaattagccgggcgtggtggcacgcacctgtaatcccagctacccggagaccaaggcaagagaatctcttgaaccagggaggtggaggttgcagtgagctgaaattgcgccactgcactccattctgggcgacagagcaagactccctctcaaaaaagaagttttctttcaggctgggcatggtggctcacacctgtaatgctagcactttggaaggctgaggcaggaagattgcttgagcccaggagtttaagaccagcctgggcagcatggtgaaactccatctatactaaaaatataaaaattagctaggcatggtggtgtgccgctatagtcccagctacttgggaggttgaggcagaaggattgcacctgggaggtccagactgcagtaagccatgatcacaccactgcactccagcctaggtgacagaatgagaccacgtctggggaaaaaaaaaagttttctttcagcaataagctagattgctctgaattaaggccatttgaaccagttagtaagacactttggcaaaagttgctgtggttattggtttttaaggccaggatggtttcccagttttaaaagagaagcctccaattcagtccagtaactagccagtgcaaatggtaagagcaaataaaggtatgtacaccctcacaatcagattgaatatggtcctcccagcagacttgaaactataatttcctagaaataatactgttggagtgacgaggatatccatttataaatagttacttattacccagatattatgctacattcctcagaaaattctggaaatgataatggtaaattatcatttaccattttctgtctcttcaaactatactcggaagttgattcatatctataaagatgcccagaagcatagtctacctttattggctataattgaacttgtgagatactagcttagtctctcggatatctcagacatttgcatttctccctttgtgggattctctgaagaaaaaatatcataaccagacgtggctacagttttgttgttggtgttagaattgctgttgccggcaataattaccacactactaccttttatttagacataaaatgaggttaacacttctgtgtctcagcaattacttcatgtttcaccatacctgcttccgtctgcagctagaggcagtgcagtgactccaggcctaaccttcgatgcttagacctaaccagtcttggaccttagaccaagacatgtaaaagttgtactattttattctaaatggagaggcctgacaatttagtgccacctttttctaagagggaaatgtagggattgcttcatgtcagtgtccaccaagagctttcttgcaagcagatcagaatttcacaatcccttctaaagcctgagttataaatggttcatactgtctagagaggccatttcattggagccatgaagataccctgtcttttgcttctttattcttaacctacaaagatagtattgtccttccatagtattgtggaagagcctctgagatcagctgttttgggtgctgctactgcttagatgtcaacttctgaacagttggggaagcagtttctgcctagctcgccaagccaatgataactctgggaaggttagaaagcagaaagccagccaggcgcggtggctcacgcctgtaatcccagcactttgggaggccgaggcaggtggatcacgaggtcaggagatcgagaccatcctggctaacatggtgaaaccccgtctctgctaaaaatacaaaaattagctgggcatggtggcgcatgcctgtaatcccagctgctcgggaggctgagacaggagaattgcttgaaccagggagtcagaggttgcagtgagctgagattgtgccatggcactccagcctggcaacagagactccttctcaaaaaaaaaaagaaaagcagaaagcctccaggtatactggtccctggtgaggtagctactaatctgccatttctccctatagctctttagagtatgcactgctgcaaagtagtaaaatagacaaaagtttcaaataggctttatgaatatagcttttaggtcctttggaattttccttacaagatgttatatcaactgtgagcataatagttgctgtatgtgaaacatatctccgcaaagaaaacatcaagccatcgtcctgatattttcaggacttgaatctaaatactttatgaccctagttaggttggtaggtagataggtagaagcattattgtataggtacatgcacttcaaacagtgtgttgatagtctttttatatcatgatttcagaaaacttctttttaaaaactgtctagtaaatatagttgagtgcagtttgctgttagtcacagaactggaatgactttgaaagtataataaacaaatgaagaccaaggttgtaaaaattagagtggacaatagacacaaaatatgtaccctagaggaagattgatacattaatatttcactttgggagatgttttgttagagaggaaattcttatctcttccttgaatacttttctggaacctttattactgcttacggcaattctacattggtaaaagaccctatgtaggctggacacagtgattcattcctgtaatctcagctaccagggaggctaagatgggaggatggcttaaggccaggagttcaagaccagcctgggcaacatagcaagaccccatctgtaaaaaaaattaacaaaaaaattggctgtgcatggtggcacgtgccaataattacagctacttgggaggctgaggcaggaagattgcttgagcccgggagttcaagctgtagtgaactgcgagagcatcactgcaccccagcctgggcaacagagtgagatcctatctttaaaaataaaaaacactttgggaggccaaagtgggcaaattgcttgagcctaggagtttgagactagcctgggcaacatggtgaaaccctatctctaccaaaaaatacaaaaactctctgggcatggtggtgggtgcctatagctgcagctactcaggaagctgaggtaggaggattgccatactgatcttgtaaaatgacttgggaagtattttctccacttcaattttttggaagaatttgagaagaatttgttcttcttcaagtgtttggtagaattcagcagtgaagccatctagtcctgggcttttttttttttctctctgagatagggtcttgctctgtcacccaggttggagtgcagtggcttcatcgtggctcactgcaacctcaacctcctgggctcaagtgatcctcccatctcaacctctcaagtagctgggacagtaggtgcatgccactgtgctcagctgattttttattttttgtagagatggtgtctcactatgttgcccaggctggtcttgcactcctagacaaatgatccttccaccttggcctctcaaagtgctgggattacaggtttaaggcagtgcacctggccatgattcagtcttgatttgttgtatatatctatgagtttatctgtttttttctagattatccatttattgttcatagtagtttcttatgatcctttgtatttctgtggtatcagttgtaatatctcctctttcatttcttattttgagtcttctgtcttttctcctagtctagataagggtttcttgattttcttcatttttccaaaaatacaactccgagtatcattgatttttttctttcattttttaagtgtctatttcatttatttctgtttagatgtttgttatttccttccctgtgctaatttggggcttagtttgttcttctttttctagttccttgatgtgtaatgaatggtatattgtttgagatcttttttcttttttgatatagatgctcattgctatacatttccctcttaggagcacttttgctgcattctataagtgtcggtatgttgtgtttccattttcatttgtctcaagatattttttaaaaattcctttctaatttcttctgtgacctattggttgtttaggcagatgttgtttaatattcacatatttggatattttccaaggtttctcctgttaactgagttcaagttttattgcattgtgatccaaaaagatacttgatatgatttcagtcctcttaaatttgttaagtcttgttttgtggtctaacatatgatctattggggagaatgttttatttgcactttagaagaatatgtattctgctgctgtttaatggaatgttctgtatatttttgtttggtttaaagtataattcaagcccaatgtttccttactgattttctgtctagatgagttgttcattgtctaaagaagggtattgaggtcccctgctcttgctgtattgtagtctgtctttcccttcagataatcaattgccctatgtttttaggtactccaatttgaggtgcatatgtatttataactgttatatcctcttagtaaatggattcctttatcattacataatgacctttgtctctttttatagtttttgacttaatgtcctttttgtctcatataagtatagctacccctgccctcttttgatttctattttcatgaaatatctttttccttctcttccttttcagtctatgaatgtccttagtagtaaagtgaatctcttataagcagcatatggttggatctcatttttcatttatttattttttagattttgtgagagtcacactctctcacccaggctggagtgcagtggcgcaatcaaggctcactgcaacctctaccttctggactcaagcaatcctcctgggtagttgggaccacagccatgcatcatgatgcctggctaattttttttatttttttatagagacagattctccctacaatgcccaggctggtctccaacaactaggctcaattgatcctcctgccttgacctcttcaagtgttgggattacaggcatgagccattgcgcctggccggatcttattttttaatctatttagccactcagtcttttgattggaaaatttaatccatttacatgtgacataattattgatagataaggacttgctactgccattttgtaatttgttttctggttatttttgacaataccactttcaattgtggtagcattattttgcttttttgaaagatttcttatcagaactttactgcgttaaaatttttaaatatttttcttccaacactatgttgaataggagtggtgagagagggcatccctgtcttgtgcccgttttcaaagggaatgcttccagtttttgcccattcagtatgatattggctgtgggtttgtcatagatagctcttattatgttgaaatacgtcccatcaatacctaatttattgagagtttttagcatgaagcgttgttgaattttgtcaaaggctttttctgcatctattgatataatcatgtggtttttgtctttggctctgtttatatgctggattacatttattgatttcctattcaacatagtgttggaagttctggccagggcaattaggcaggagaaggaaataaagggtattcagttaggaaaagggaagttaaattgtccctgtttgcagacgacatgattgtatatctagaaaacccctttgtctcagcccaaaatctccttaagctgataagcaacttcagcaaagtctcaggatacaaaatcaatgtacaaaaatcacaagcattcttatacaccaacaacagacagagagccaaatcatgagtgaactcccattcacaattgcttcaaaaagaataaaatacctaggaatccaacttacaagggacttgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcacgggcaaggacttcatgtctaaaacatcaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaaggggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataagaacacttttacactgttggtgggactgtaaactagttcaaccattgtggaagtcagtgtggcgattcctcagggatctagaactggaaataccatttgacccagccatcccattactgggtatatacctaaaggactatgaatcatgctgctgtaaagacacatgcacacgtgtgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggagaatatcacactctggggactgttgtggggtcgggggaggggggagggatagcatcgggagatatacctaatgctagatgacgagttagtgggtgcagcacaccagcatggctcatgtatacatatgtaactaacctgcacaatgtgcacatgtaccctaaaacttaaagtataaaaaaaaaaaagaaaaagtaagatgattggaaggaaaacaataaaatgatccttattttctggtaacataaaaaaaaaaaaagaaaaatgcaaaggcaaagaatcgatcaggttggcagaagctgttccctggcttatgggcaggagggagctggtgaggctttggaaattctattgctaacactaacacgggagatctttctggcctttctggttttggcaatggctctttttctcctgccttctaaggtactacaggaaaaaatatttcctctacctccatcccacattgcccaggaacattttaaagattgaaggctttctcaaaaaaaaaaaaaaaaaaattaatatttttcttttaatcatgtatccctttcttcaattaaaattttacacaaaaacccagtaaataaaatgaagtggagcttttgtagttgaaatgggcggagggatatctgcagtctcatctatgtagaccttaccaaagttcagtccagtggctgtggttttttccttccacccaaagaaaagcctgacagtccaatgactgtgatggtcactacatgccaagaggcaagggtatgatgtagctctgtttcattttttcagcttttagaaaataacgtgtggtgcaaagcattaatataggctatgtagtagtgcaaagacataaagacagttattacctaggtgcttcagcacactcaagatttttcttttagaatcatgcaacaggatttaagaactgtaaacctgaaaaaaaaataagcttcttacaggcttgttctatggaaatcctatgttcagccaaaaaagttttttgttagcagtatagatttgaccactgattgtgttctgtggactgtcccatgatgaactgactgatcaaggcataaaaaaccaaagcaagaatatgggtatattttatttgtaatgagataaaatatatgagataaaaatagcagcaggtacactgctgaaagaccagcatggctacagttgtctcttgggcccattaaacagcttaatttatgctgctagcccacagagcatgagttggcaggatcaggtggttaacctagaaatcctggagtccagctagattatatttcatcagtggtacattaactgaacccaaagtatgcacataatgagagaacctgcaattatttgacatctatttgccatagcacagacaccgtcctcggcatcaaataattgcaagctgtgaggtcagaaagttggaattaaggattcatgaagcccagagttagataatatggctgagctgcaaactgttttgaagtggcagcttcagaatggtgaccctgcctatggtggtagctctttttaagtgaaaagttttagtgagatgtaggcctctgaaaaaagggtggcatactttggctagaacctggaactgcagtggaaaagcacacgttttacaattgtagagatctgaaagggcatgcatacaattaccacctgctcttagctcttcaattcattcctccctttccttatgacttgcaattatgtgtatgtctcctgtagttaaattcatttgcttttgtactttattatatattgtatgtggaaataattaacaaagtcttgagttgtttgtttatacttccaaatgaacagctatgatttttagcctacataagagtgctggtattttatatttgattttcctaagttttatatttaattcccatttgcttgacattgagaaatatttataattcatagcacaaaagcctgaaaccattagcttttctgtagagatagaacagttcgtaacatgtaataatgatgatagtgttagtaatgttgccagactcttttatatccatccagttttttccccattgtaagattcctcaaggacacagatttttgtgttttacagtaagtgtttagtcagtgcttttgactgactcagagaatatgatattcaactgtggtgaattctttatagtgcaggattaaatggataatttttcccctagaacttcacaggactgtccttcttttcatcatttaaggctttcaaatgtcacctttatatggaggtattttctgacctccttcttgtacatagttcatgttcttcagagtattagccctatttgcaagtatgcttttgtctgttctagtctttttcccccacgctaacataatctctttgagaatggtaatgtatttaccagtcactttgtggctagactgtacctaacatagcaggtgattaatatgtatttgttgactgattttttatctctttatttaattttaacttttgaattacatttgcatgtgatttttaccccctgttccttttcagtttttcagaaactttggaattggcagatgacatggccattgatattccccatatttggttgtaccttgctgaactggtgacccccatgttaaaagaaggtggaatctccatgagagaacttaccatgtaagttatacttgtttctcttgatatatatcaggtagaactgactaataactcacttgctagctctctatcatagtactgtcccattatcgcctttggagactcatgaatgcaggctgtgactctttaagacttctgatttcagtgtaaaaatgttaccttatgctaggtctacacctgagatattctggggatatgatagccctgtggtctgttgagggtagtggcgatgatagattggctccagaatcgtgtaactggaagatgactgcttctagaagcttaatgttcatctggcttttgtgtctatcattgcagtagtgctgtaagtagttatattttcccattgtaacttgtcagactgcattaccccatagtacatgctcatgattataataaaaggatgattataataaaacaaactgagatctcaagtattcctacgtttggatgtgagtggggaatggatgctacgttatatagaccggtggttcccaaactctgttcttcgaaacactagtgtttccacaaaagttgtttatatagtcaaactttgcacatggtcatgtcccttttctttgagattaacaaaacatacttagcatattaaagtttatgacagtcctatagtaaagcaataaataaaaactagttagctttgtttaattcagcattgcctcacttagagtatagatatcctatggaacacagtttggtaaatgctgatttagactgttacaaaattggcccctttgctgtttcatccataatttcatctataaagaaaagcttcctttcttaaaaatactttatatatggccagacgcaatagcttacacctgtaatcccagcactttgggaggccgaggcaggcggatcacaaggtcaggaaatcaaaaccatcctggccaacatggtgaaaccctgtctctactaaaatgcaaaaattatctgggcatggtgttacgtgcctgtaatcccagctacttgggaagctgaggcaggagaatcgcttgaaccagggaattggagattgcagtgagccaagattgcgccactgcactccagcctggcgacagagtgagactctgtctcaaaaaaaaaaaaaaaaaaaaaactttataaaagcatcacaactccctgttacctaaggtgcttctcattttagcttgaagcagaacttacataaacaaacagattaccacatctgatctttgtgttgcttctgtcactgaagtggttaaagaaaaaggtaaaaaccaagaactcacatgtaccttttcaggaacttctcctgaaaatgacttagagcatgtcctggagctttggcttgcccagtattatgtaggttgcacagtatctggtttttggtcacacattgtttgcctcttgttctagaagaaaggatttctttagagatacttaatcactgctcctatcttttacagagaatttagcaaacctttacttcctgttggaagagctggggtcttgctatctgaaatattgcacctactatgcaaacaaatggtgagtgttacactgagtgtcagactcaacagtattattaggaagggcagtgatcttgatcttgggttatctgtgaatagcttaggtctcagggtgcaagtaattaagaatgaggtctctgcttcaacccagtttctttctgaggtgcatttgtccttctgtttgctaatatcttggggcagaattatcaaatctcgactagatttggtataattctaaagaatctcaagtcatgttttatttgtagttgattttttcttcctttgaaacaaaatggatatatcatttatatgttttaatagatttcaacgaaaagctccatagagctggaggctgtcagtctatggcaggctgtcagtctataaagtgggaacagataaatctaaaccaataatttcaaaagagtgaaagtgctttgttagaagtctaagaggtttggggaagtgttgtggcatcacaaagggaataaaatgtctaggatgagagggatgagagatgtcaaaacaaaacagaactcagaaatgaagattctggagtgatttctgacttacttacgcctgactcaaagatattggatgatagattttaatgtttaaagtcagtgtttcattcctccctctgatacagaagtccttctgtatcccatttgtgtggtagttattcataaacagatgtactaaatatcctggtctctagttctgttgactatttgttaatactactctttgcttaatggcactaaaatttttactgaaccctagtttttatgtccaaaatttcctcctctccgacctacttgactttagtccttatttaaaactcacattctggccgggcgcagtgattcacacctgtaatcccagcactttgggaggccaaggtgggcagatcacgaggttaagagatcgagaccatcctggccaacatggtgaaaccctgtctctactaaaaatacaaaaattagccaggcatggtggcacgcacctgtagtcccagctacttaggaggctgaggcaggagaatagcttgaacccgggaggcagaggttgcagttagccgagatcatgccactgcgctccagcctggcaacagagcaagactctgtctcaaaaaaaaaaaaaaaaaaaaaaaaaaagaaagactcacattctggctggcacagtggctcacgcctgtaatcccagcactttgggaggccgaggcgggtggatcacttgaggtcaggagttggagaccagtctggccaacatggcaaaatcccatctctactaaaaatacaaaaattagccaggcatggtgacaggcacctgtaatcccagctacttgggaggctgaggcaggagaatcgcttgaatctgggaggtggaggttggagtgagccaagattgtgccactgcatttcaacctgagctacagagagagactctgtctcaaaaattaataataataactaaaaactcacattcttattaactttgatgtgtagaaacagcacaaccctacttccaaataaaactaaattctcatatagtataagctttggagccagatggccgagttcaaattctggttcaactatattttcagctatgccttggacaagttactctatgaagtaattaatacatacctctcagatgacagcaacagcctcaaacctggcattttccgttgtcactgtaactttcttcaggtagaggacttgtacctcttcacttttttctacctgacaacagctcttctttattctctctcttgggctcaaccttgtgcttcttgcccttgaaacacttctcattcctggttcaggagcaacaactgctttaagcctccttgtatcaggcagcatggctgtgatctattatgaagagggattctagtgaggcttcttgaatggctttaatagcagatacatacagagctatctaggaaaagacacagtgtggaatttataaactctgtgtattggactttttttgatgtttataaatcccaaataaccagctgtagctccccagattagtcacctcataaatcaattatttaatcttaagcagctgtacttcaattattcaccattgtatttatgtgcattcagacatcttagtttgaaagtcacaagtcttaagagattaactttttatcagtgaggaaaagtttgttttcgagactggtcttgctgtgtgtgttgcctgggccagacctcatactcctgggtgaaagctgtcttcccacctcagcctccctagtagctaggactatacaggtgtgcaccaccatgccctgctggaaacgttttgatttttcagctttttggggtttgcactgtttgacttcaagcaaatctttttttttttttttttttctgtttcttcttccactgtgaaagtaaatggattggatttatctctattttagagccataagaaagtgggagccttatggagggaggctgacctcagctggaaggactttttaccagaaggagaagatgtacataattttcttttggagcaggtaagaacaaggcttatgttttgctgtttgatagtagttgatctatttcatagaggaagtgaaggtaatttccttcgtattccagtcgttaaaattgcatcaaaataggaatcttggtaaagatgtccttttaagttcatgcttttaaagccactccaactgtgtggtcatcagatgattgatatttaaaaaaagaaaatgtaaaagacttagcaacctatagaaaaacaagctacagcaagcagaaatgaagttaacaaataaagcagggtgacagggccaaagctgtctcctgatttctgggtctgatggcaggccagaagcagccagaagttattctgtggggaatggagaccattaatacccttataaggtagaagattagagacaagcttatagcttgaaactacacaggtaaataagtgcaaggaagtagacacagtcttatacccagaaccttagctatcctgcctactgactggtaactagatccagaaatctacaaaacagaagaccccatgatcagtataatctggtcctataggaggatttgtgggctgttaggttgaggtaaccataaaacaaattagatcaagaaaagtaacagaaagaaaacaaaactctctcaaaacgttactgaaaatcaaaatcctaaaactcatgaggaaaactaaagctaagacagccaacaaaatcaggaataaggagaaaaaaaatcaccataggtaaaaagagaacaagaatgcaatctgaaaatgactttaaaataagtattttgttctggataaagatattatattaggttgctacagacattagctttctttttggttgtagtctggaacactgaagagcattcttgccacagcaataagaacctgcatgaagcataacttctgatgtgttactggacttagaagaggtggaagtaatttccttcaaagggacaaaaagaattaatgagggggaaaagccagagatgaaacctgaactgtgaatagtaattacatgtgaagggcatattgcccaaaggacacatagcccagtgggaagatactattacaaatgctgtcagatgtcatggaaaaagttgacttagtcccagttcagtattaccttggctcccagaagcagcaaatcaaaatgctctttggagaaacatcctcaacttaggtccccttattttctacaaatccaaattatttaaatatatgagttgacacttggtgttcatttaacatacaattaaagaagtaaagataaaagtaaacagacaataagtagtagatttagaccccatggacttgaggtaatggaattatcattcagagtataaaataacactatagtaaaagaaagaatcacaaaaatgagcaaacaagagactagtcaaaatggttaaagagatttgaaaagaaaagaaaaggttgggtgcagtggctcatgcctataatcctagcactttgggaggctgaagcaagagaatctcttgaagccaggagttggagatcagcctgaacaacatagtgagacctgtctctactaaaaaaaaatagctaggtgtattggtgcacctgtagtcgtaagctactcgagagactgaggcagaaggatcactagagcgtgggagtttaaggctgcagtgagatacgatcacaccactgcactccaacctgagagacaaagtgagagcctatcaaaaataaaaaataaaataaataaacaaaagccacacacacacacaccaaaatctgtaggtagctatctaagatatgttaatatgttaggagatttggaggaaagaatgagagaacatctaacctatctaattggagtcccagaaggaaaattagcctaaatggagaagaggcaatatttgaagagacagtggctgagacttctagaagtgataaaatatacaaatctataatgaaagcccatatatgcaatacaggataattatattttagtgaaactgcataataccaaagacagatgaaagattttaaagaagctgggaagaagaagcacattacttacctgcctccccctcaaaaaaaaaatacacaaaaaattagactttgcagtagcaaccatgaaagccagaagatggtagaataatctcagagtgctgagaaacgagcagtaaatgtagaattccctgtgcagctgaactaacctttaagaattagggcaatgcatactgagaaacttaacaacatacttctaaatacccatgggtcaaagaagaaatcaaacatgatagtaaaaaacatttttaactgaatgaaaacaaaaccacaacatatcatcgatatttagaaaagaagaaaggtcaataacctcagcttcaaccttaaagaattagaaaaataaggccagacacaatggctcatgcctataatcccaacactttgggaggccaaggcaggaagattgcttgagcccaggagcttgagagaccagcccaggcaacagagcaagaccctatcaccaaaaaaaaaaaaaaaagaaattagaacaataagaacaaatgaagctccaagcaaatagaataaaggaaataataaacattatatcagaaatcaatgaaatagaaaaatttttagagaaagaccagtgaaatcaaaagctggttctccaggaggtggaggttgcagtgagccaagattgcaccattgcactccagcctggacaaaagggcgagactccgtctcaaaaaaaaaaaaaaaaaaaaaaaaaaagctggttctttgagaagataaaagtgataaacctctagccagattgatcgtgaaaaaaagtttgaaaagaaggtacatattactaatatctggaatgaaagcggtaacatcagcacagattctatacataaaagtgggtgaggaaattttatgaataatctttatgtcaataaatacatcagccaggcgtggtggctcatgcctataattccagcactttgagaggccgaggcgggcggatcacgaggtcaggagttcgagaccagcctggccaacatggtgaatccccgtctctactaaaaatacaaaaattagccaggtgtggtagcacacgcctgtaatcccagctactcaggaggctgaggcaggaaaattgcttgaacccaggaggcagaggttgcaatgagccaagatcacattattgcactccagctctgggtgacagagcaagactccatattgggaaaataataataataataatgtagggtttatcctagaaatgtaaggtgggtttaatatttgaaaactgatgtatacataatagggaagatggtgaagtatacataatagagaagtatacataatagagaagtatacataatagggaagatggtgaagtatacataatagggaagtatacataatagggaagatggtgaagtatacataatagggaagtatacgtaatagggaaggtggtgaagtatacataacagaagtatacataatagggaagatggtgatgtatacataatagggaagatggtgatgtatacataatagagaagtatacgtaatagggaagatggtgaggttccaggattcaatccctccactgacacaactattgaactggcaagatctgttagagccaactgttttagaactgtggagtctcgttaaatacatgcattatcaacaccaggggattgcataatgaaaaaagagtctgataaatttcagtgaatttgggaattttgcatagaacttaccagtacccagcccagtggcagaccaccaggaaactggcatcacaccatttctggtgcagcttgctggtgccaggttgaacaataaggacttcattttccaaggattggggttgtgtcttttaattgacttttagttgactgagaggccagtgctggggctggctgttatttcaactctttcatgctgaagtatcttttagggctgtgactatcaaaagtatttaagcagtagtgttaacgggatctctggagtgtcgatttttttggccagaaacctctgtggccatggcacctttgcccgagttcttttcctgtgtccaggaagaatgaggtacgcaaacaaatgaagggtgaagaagagttttatttagtgttagaacagctcagaggagtgggtagctcctctctagtaggcaggttgtcccatggagtgttcagctctctgtagagaggaggctctggagaggatagctcctctccacaggcaggtcgtttggacatttctgcaggtctctgaagctctcagaggagagggtacctcctctctcctggcaggtcatctctgcagctctcagcagagaaggcattcttctctgcagctggtcctccaatcgtctctctaccctctttgtcctctgcccatctgctaccctgttctggctgagtccagggcttttatacctcagaggggaagaaatgcatgccaattggtccataggcagccatggttgggcctggaagaggcaccatgagcccctactccactctgctggactggcatcccagcccccagccttcaggtcctccctggcctgagggtggggccttactggggaccctgcccccttccacccaggactctgtctgcctcctgctgccattcatggccctggggcttggtcccaaccccactccaagatcagagagcaggcaactctgagcctgcagggacagggggtctttcctgggacacccgagggtgctgactgcagagacgcccaggtgctgcatgcctaggagggcagccacagctgcaccccagagctcccaccccaccaactcagaagaggcagggctcccccttttcccgtcccctgcctgctttgtggaacgggaggcccaggtctgcagccgcaggtcaggcagctgcgacagcacccaggaggggagatcctgcctgctccctcaagaaaggctcgaatccacagctgcagtttgggtgggagggcagggctcctgcctgctccaaagagcaggaggcttgggtccgcagctatggtttgggtggctgcagtagcacaggcagcttccatcccaactcagaaggggcagggctcccaccggctccatgcagtgtacggccccagctgcacctccctgctgcagccaatagtatctctctctctgtctctctctctttctttctgtctccagtctctctgtctcctctcctctcccctctctcctctttcctccttctccactccctctccctgagtcctctttttttgttaatttaacttttattttaaggtcaggggtacatgtgcaggtttgttctataggtaaacttgtgtcatgggggtttgctttacagattattttgtcacccaggtattaagcctagtacctattagttatttttcctgatcttctcccttctcccaacctctgccctctgataggttcgtgtgtgttgttcccctctatgtgtccatgtattgtcaccatttagctcccacctataagtgagaacacgcagtatttggttttttgttcctgcattagttcgctaaggatcacttggcctgggaggtcaaggctgcagtgagccatgatagtgccattgcactgcaacccgggcaaaagagcaagaccctgtctaaataaataaataaataaataaataaataaatatgagacttcagtttaaaagaaaaaaaaagcaatcggaggtcaaggctgcagtgagccttgatagtgccactgcactgtaacctgagcgaaagagcaagaccctgtctaaataaataaatatgagacttcagtttaaaagaaaaaaaaggcaaaataatatatatataataaaatgaatatataaaaatgtttatagtttgaaaaatgaggttgaaaaatacttggcctgtatcttgacttacagtttgcttaaacagcttatggccttcatgttgtgcttttttgcatatattggagcatcatggattggatgtatagttaaccaatactaaatcagaaaaattgtaatattgagccatgtttctaaaatcttatggagctgggtgcagtggtgcacactgtagtctcagctgctcgggaggctgaggcagaaggatctttgagccccagagttcaagtccaacttggcaacatagtgagaccccaagtcaaaaataaataaataataaaaccttattgggaaatataatttagagatgctacgtaagtggtagaaacggaacaatcagatgacagaactcaagactgtggttttcactttgtggattggggatagggtataggaccataccagagtattcaagagtattagagaaaaccttatgtgagtaatccttaatattttcatctttatggtttttgtataatgaagccacataaagcaaggcatacctatgtacttcatttctttagtcctttgaaaattatgaataattttgattatagattttttttttctttttgagacaggatctcgccctattgccaggctgcagagcagtggcacaatgacaattcactgcagcctcaacctcccatgctcaagcaatcctcccatctcagcctcctgagtagctgggaccacaggcgcatgccacaacacctggctaattttggtatttgtgttggtagagacggggttttgccatgttgcccaggctggtctcaaactcctgaactcatacactcctcctgccttggcctcccaaagtgctgggattactggtgtgagccactgcgcccagcctgattatagattttttaaaactatgtatctaagtgctaaacaattatagcatcatttctcacacctatattcgaaatggccacaacttaacaaagccaaaactatctagttttgatagctgctgagtaccaatactaatattaaaccataggttgcagaaagagagtgaaattgtacccttttctagggctcctatcctgccttaaagagctatgttgcagctaaggggaagattgaagctcaagattatttgcgtgtaaccatagcctagagataattatagggggttattaccttcttttttaagatacacggtatgagaagttggaaaaatattcagaaggataatggactgacagtttttcaaaactataatacgaacaggttgggcgtggtgagtcatgcctgtaatcccgtctttgggaggccaaggagggcggattgcttgagctcaggagttcaagaccagcctgggcagcatggcaagaccccttctctactaaaaacacaaaaaaatagccaagtgtggtggtgtgggtctggagtcccagctactcaggaggctgaggtgggaggattgcttgagcccgtgatgtggaagttgcagtaagccaaactactccagcctggatgacagagcaagaccctgtctcaaaaaaaaaaaaaaaaaaaaaactacaaacataaaatagcctctgctgatcattttgattccatgtaaaatagaagacgtaacctatgactttgttcttctctcaggatgacaataacatagaattatattaatatattaatatgttccaccttttatgtttcagaagttggacttcatagagtctgacagtccctgttcctctgaagcactttcaaagaaagaactgtctgccgaagagctgtataagcgactcgagaaactcattattgaggacaaagcgaatgatgaacagatctttgactgggtagaggtataaagactatgtcaccttccctgatacctctacaggaaagattcttgtgggatccccttaattcgcttacctatcagttcacttcatgaatttttatttttatttttttttatttatttatttttttatttatttattttttttttttaattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacgtgtttcagagagcacagggttggggttaaggtcacagatcaacaggatcccaaggcagaagaatttttcttagtacagaacaaaatgaaaagtctcccatgtctacttctttctacacagacccggcaaccatccgatttctcaattttttccccacccttcccgcctttctattccacaaaaccgccattgtcatcatggcccatccccaatgagccgctgggcacacctcccagacggggtggtggccgggcggaggggctcctcacttcccagtaggggcggccgggcagaagcgcccctcacctcctggatagggcggctggccgggcggggggctgacccccccaccaccctcccggacagggcggctggccagacagaggggtcctcacttcccagtaggggcggccgggcagaggcgcccctcacctcctggatagggcggctggccgggcggggggctgacccccccacctccctcccggacggggcgactggccgggcagaggggtcctcacttcccagtaggggcggccgggcagaggcgcccccacctcccggacggggcggccggccgggcggggggctgacccccccacctccctcccggacggggcggctggccgaccccccccccccccgcctccctcccggacggggcggctggccgggcagggggctgacctccccacctccctcccggatggggtggctggccaggcggggggctgacccccccacctccctcccggacggggcggctggccgggcagaggcgctcctcacttcccagtaggggcggccgggcagaggcgcccctcacctcccggacggggcggctggccgggcggggggctgatccccccacctcccttccggacggggcggctggccgggcggggggctgacccccctcctccctcccggacggggcggctggccgggcagagggatcctcacttcccagtaggggcggccgggcagaggcgcccctcacctcccggacggggcggctggccaggcggggggctgatccccccacctccctcccggacggggcggctggccgggcagggggctgaccccccctcccccctcccggacggggcggctggccgggcggggggctgaccccccacctccctcccggactgggcggctggccgggtggggggctgacccccccacctccctcctggacggggcaactggccgggcagaggggctcctcacttcccagtaggggcggccgggcagaggatcccctcacctcccggacggggcggctggccgggcggggggctgacccccccccacctccctcccggacggggtggctgccgggcggagaggctcctcacttcccagacggggtggctgccggacggaggggctccccacttctcagacggggcggttgccaggcagagggtttcctcacttctcagacggggcggccgggcagagacgctcctcacctcccagacagggttgcggcccagcagaggcgctcctcacatcctagacagggcggcggggcagaggcgctccccactcagacgatgggcgggtcaggcagagatgctcctcacttcctagatgggatggcagccgggcagagacgctcctaacttcctagatgggatggcggctgggcagagacgctcctcactttccagactgggcagccaggcagaggggctcctcacctcccagacgatgggcggccaggcagagacgctcctcacttcccagacggggtggcggccgggcagaggctgcaatctcggctctttgggaggccaaggcaggcggctgggaggtgtaggttgtagtgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaacccagtctccaccaaaaaaaaacgaaaaccagtcaggcgtggcagcgcgcgcctgcaatcgcaggcactcggcaggctgaggcaggagaatcaggcagggaggttgcagtgagccgagatggcagcagtaccgtccagctttggctcggcatcagagggagaccgtggaaggagactgtggggagagggagagggggagggggagggggagggggagggggagggggagatgaatttttaaccttaattaaattagtttttaaatgcttttgttttgccttccttagaaaagagtaacatttttctcaccacttaaggggttaagtaatgcttgagattaacttctaattcacattaaaattaagatgaaaaagcagtgttggcacatgtaaaaatagttacatgcttctgagtaagtagtcattaaaatacactgcagttgtggtgttgttctttcatagattgagtagatgatcttaatatggattatttattgaggaataaaatatgtttttaagtggttatacttccaaatgtacaagtacataacactgtataattgaatgagtaaaggataggcagtgggaaggaccctgaaaagtaaatactgctaattcaaatatttgcacatagaactggcaatagccaaattatttttcaatgaattggacatttaattttagcaagaatgtgcaaaaatgtgattcatctggtctgggtgtgatggttcatgcctgtaatcccagcactttgggaggctgaggtaggcagatcacgaggtcagagtttgagactagcctggccaacatagtgaaaccccatctctactaaaagtactaaaaaattagctgagtagtcccagctactcgggaggctgaggcagggatcctgtagtcccagctactcaggaggctgaggcaggagaatcgcttgaacctgggaggcagaggttgcagtgagctgagatcgcaccactgcactccagcccgggtgacagtgcaaagtctcaaaaaaaaaaaaaaaaaaaaaacagtgactcatctgttcttagtgccagatcagtcctgatgttcaagagatcatttatctgatacgcaagggtatctttttttgttttttgttttttgttttgagatggagttttgcacttgtcgcccagtctggagtgcagtggtgcaatcttggctcactgcagcctccacctcccaggttcaaacgattctcctgcctcagcctctgcctgccaccatacccagctgatttttgtgtttttagtagagacacggtttcaccatgttggccagattggtctcgaactcctgacctcaggtgatccatcctcttcagcctcccaaagtgctgggattacaggcatgagccactgcacctggcctgttttttgttttctcaagacaaggtctcgctctgtcacccatgctggagtgcagtggtgcagtcattgcttactgcagcctcaaacccttgggatcaagcagtcctcccaccttagtctcccaggtagctgggaacacaggcatgtgccaccatacccagcttttttttttttttttttttttttaagagatagggtcttactatattgcccagactggtctcaactcctagcctcaagtgatcctcctgtctcggcctcccaaagtgttgggattacaggcatgagcctctgtgcctggctgagcaaggtatctttaattgttttatttctttttgacttcaggctaatctagacgaaatccagatgagttcacctacattccttagagctttaatgactgctgtttgtaaagcagctattataggtaagtaacatttctgaaggcagctcataacatctgaaatccccattatgtcaactactaagtatacagtttgattttacattgttttcaaaacttctcctatgtagctcacttttctgtgcactgtcctttctgtctgtgatgcctggttgtctcaagcgtggagacaaatagctgctccgcctacagagaacccagatctaaccagctaccacatgccttgcatgctccttgggttgtttttcactacgttgcgtgtagctttttctttatcttttcacttctaacattcagggccgcctcctccttccaataatgaattataatgaacaggttgaatattcttaatctaattatcagtatagggttattctcatcaaaaaagtcatgttatataagtacatacatgaagaaaaaaatatcaacagtttgtcctgttctttgttgactttatttgatatgataagacaattttattggcttatgaattgttaatattgataggattagggtcagtagaaatcccaaatattccaagctgtatacaatgtttaacattattcaatgaagacatctctttagtttcagatagaaattcatacttctgtcactgaagcgagaaaaaaaaattcatcagtgcaaaggtgtctcagaatttcaagtctgtctctattttgaagatggctttctgccacttaatatagcttcagaattgtaatttaagatttgcaatgaatttattttcaatgttctttaatgagataaataacaaagctaagtagaaagtcttcatgaaatttttaaaaatcattttcagtatccatagaaccatcataagactttcatgttttaaaattcgagttgggaagtccaaaagctgtttggtttttgttttcttgagatggtgggggtcactgtgttgcccaggctggacctgaactcctgggcttaagcggatcctatcgcctcagcctcttgagtaactggaattacaggcatgagccacgatggccagattttaaaagcaaaatctgcttttaaaaacaaaattgtgtcttagtgataacttacagataatataaacccgtatgtgtctttgtactgaggatgcttttcatttctcagcccctttttatcattcctttccctcaaaaggcctagattaggtatgttatctgccactgccacagttagtttttatcctagtaataacaaaatggttccaattattttagccttctgaaaagatttgtattaagtgtcactttaatttccttttctaatgttgcttttttatgttgctttttttaaatactcacttgaaattcctactccatgtttcatttatttttgattgacaaattataattgtatatgtttatggggtacaatgtgatgttttgatatacatgtccaatgtggaatgattgaatcaaattaattaacatatctatcacctcacttacctttttttatggtaagacatttgattaattttgcttttgtagtttgtcataaaaccacagtcactgtttcattacaattaaagataattgggtacgctactcctgagggaaaccagcattcaaaatgcatcccctccatagtttttattatttgtgagagaatgtctcattaataatttcagagcattttggatttcaaaatatttgccttagaccttcttgcctcctcttctcttgtagagccatatgggtcctttgtactcagaaaattgaaaatgagccaggttgcagtggctcatgcctgtaatcccagcattttgggaggccaaggcagaaggattgcttgagcccaagagttcaagaccagcttgggcaatatagcgagaccctgtctctattatttaaaatctaaaatagaagaagaagaagaagaagaaaggccaggagcagtggctcatgcctgtaatcccagcagtttgggaggctgaggcgggtggatcgcctgaggtcaggagttcgagacaagtctgaccaacatggtgaaaccctgtctctgctaaaaatacacaaaaaaattagtcaggcctgggagcaggcgcctgtagtcccaacaacttgggaggctgagacaggagaatagcttgaacctgggagacggaggttgcagtgagcttagattgtgccactgcactccagcctgggcaatagagtgaggctctgtctcaaaaaaagaaaaaagaaagaaaattaaagataattctatgttaactccttaaatgtaattcctagttcttctatcacctttagccgactcttctaccttcagagtggacactgctgttatcaagcagagagtgccgatcttactcaagtacctagactcagatacagagaaggaactgcaagcactttatgcactacaagcatcgatagtaaaacttgatcaacctgccagtaagtttatctcatgttacagttaatctaaccaatgagtgagatttatccaagccaggacttagagatgatttagggttcgaacaaaggacaataaaagaatcactaataacacaaactcatataactaactttaataaatttgaatttggccgggtgcagtggcttgcgcctataatcccagcactttgggaggccacggcaggcagatcacttgaggtcaagagttcaagaccagcctggccaacatggtgaaaccctatccctactaaaaatacagaaatggctgagcacggtggctcacacctgtaatcccagcactttgggaggccgaggcagatggatcatgaggtcaggagatcgagaccatcctggctaacacagtgaaaccctgtctctactaaaaatacaaaaaattagctgggtgtggtggcgggcacctgtaatcccagctacttgggaggctgaggcaggagaatcgcttgaacccaggaggcggaggttacagtgatccaagagcatgccactgcactccagcctggcgacagagcgagactctatctcaaaaaaaaaaaaaatacaaaaatacaaaaattggctaggtgtggtggcatgtgcctgtagtcccagctacagctactcagaaagctgaagcacgagaatcacttgaacctgggaggcggagtttgcactaagccaagatggcgccactgcactccggcctggacaacagagcaagactctgtccaaaaaaaaaaaaatgaatttgttatatgtttgtatgaaaatatcacaacaagaaaactatttagattaggttatttcatccccattccagggcaggcctaataaaactttccacagtgatggtagtatatatccataccattgagtatggtaatcatgagccacatgtggcaattctatacttaaatatgtctgttgtgacttaggaactgaattattgactttaaatttaaataaccatgtttgactaatagcttccatattggacaacacaggtctagggcatgaaaatggttaatgatgttgaggatgatactctagaatctttagacacccaacaaagaccctaagtgtagtgtatttaccatgctatatttactaaggagtttcagaatagtttttagttaagggttatgattaattcttggctaatgaaacaaagtaacctgtacacttaagtcttagtgatacttggtgttaactaatgatttttattacatcttgaaaattcagttggtatttgttaaagcgggcagtacatagctattagagagagcactcaagtagttctttggtacttccttattttcgcttttgtaaaattccttctttcctagtcctgaatcgctcttggagataaaggaaaagatgaaagcaaattatccttatagtgtaactgaagagacaatctaccatgaatcagataatttgataatattagcttaactaatataattacaaagataagtctttttaaaaaaaggccgaggcatgcagatcacccgaggtcaggagtttgagaccagcctggccaacatggtgaaaccccgtctctactaaaactacaaaattagctgggcgtggtggcgcatgcctgtaatcccagctacttgggaggctgaggcaggagaatcacttgaacccatgaggcggtggttgcaatgagccgagatcatgccactgcactccagcctgggcaaaaagagcaaaactccatttaaaaaaaaaaaagttaatacgactcatgataaacctaatattgattagcatttattgtttattccactgcctccctccattaatataaatgatcggagagctgactataataactataagctaataacttattatatatgataactataattctcagttttactatgagagtaaaaccgagaattaaaatcacacggatagtttggacgtttaaaacagtaaataacaggtgtagtttcactggataaaatccagatgagatagcttttactcatgttttccatgtgaatgatcacctcttgttcttttttgagacggactctcgctctgtcacccaggctggagtgcagtgatgcaatctcagctcactgcaagctccgcctgccgggttcacgccattctcctgtctcagcctccctagtagctgagactacaggcacccgccaccatgcccggctaattttttgtatgtttagtagagacggggtttcactgtgttagccaggatggtctcgatctcctgacctcgtgatccgcctgtctcggcctcccaaagtgctaggattaaaggtgtgagccaccgcgcccggccacctcttcatttttaaaacaacattacaaggaataaaaagcatatcctgcctttctcccttcccccaaattttgtaaaaataatacagtaaacttgcagcgcagaaaatagtaaaaagaaagtaaaaaactactcgtatttaaattttatagggtttagattgagataaacatgatatgaaacagcttcactggtatcagaagatagttcagattgggccgggcacggtggctcacgcctgtaatcccagcactttgggaggccaagatgagcggatcacctgaggtcaggagttcgagaccagcctggccaacatggtgaaatcccttctctacttaaaatacaaaaattagctgactgtggtggccggcgcctgtaatcccaggtacttgggaggctgaggcaggaaaattgcttcaacccaggcaggcgcctgtaatcccaggtacttgagaggctgaggcaggaaaaattgcttaaacccaggcaggcgcctataatcccaggtacttaggaggctgaggcaggaaaattgcttaaacccaggaggtagaggttgcagtgagccaagatcgcaccactgcactccagcctggggacagaacaagattgtctctcaaaaaaaaaaaaaaaaaaaaaaaaaacagaaaaaaagttcaaattgtacaaaataataggaataaaaaagaatttagactgcttcaatctttttttcctcttctttaaacaagttgttgggctgtttatactgtcaagagcaagtatggtgaattgtcattattgcttttttctgggggaattaatgcacatttattcagtcattcattattttgaaatatattcttttcctcataactacagtgtcccaaagcttatagtttattttcacctccttgcagatttgctgcggatgttttttgattgtctatatgacgaggaggtgatctccgaggatgccttctacaaatgggagagcagcaaggaccctgcagagcagaatgggaagggcgtggctctgaaatctgtcacggcattcttcacgtggctgcgggaagcagaagaggagtctgaggataactaaaacttcaaatacacaaaatgaaacaaaagaaacaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgttttaatcttttctttttaaacaaggactcatacttaaaaaaatgtttagcaaaaaaaaaaaaagttgagaacttttaatttattttaaggactgcaaatgccagtgtaattttttaatttgcagtttctgtaaacaacttgtataatagaaaagcagagaaataaatttccctccccttcaagatgcacctcatgtttgttttaaggtatagcatttagtccagatttgagaaagtttggggtgaacaaggtaagaaagatttttttttttttggcatcaaatctttctgcctgcctctcagcttgcttcagaaaatttaaaaaatcacaatagtaatcaaaacatacataacattgaaacagaaggaaatgctgtggaccacagaactccaagaattgtttaaaaaaaaaaaagtgctaccctgagaaaagtactcttaatactcttgaaatctttagagcaactttaaggcttgtaaatacatagaacaaatatttaaaaaaacaaaaagaaattgactcagtactatttcttttcactttgaaaatataaagaacaaaataaagacaaacattgcaagtttaaaagaaagtaaagtgacttctcctttggacagctgctgcatgtgtgcccattcctgggggtgctgtctggctatttattgtctaattcaaatcactcctgaggggagagagataaaacgagagagagtgagagagtgtgtgtatgtgcgtgtatgcgcacgtatgtgcatgcacatgtatgtatgtatatgtctctactcactgaaaaggcaagctactttgtgggtaaggagggcacttgtgcttgggtgggaatgccccactgggagtccagtgaaacttgtttccaacactaactaaaaatgcattcaggacagtaggcctcaagggcagtcctttagataactaagttttccactctgtgtatcaggactcaggacaataattcactttgagactgccactaccactgattttaaaatcttccatcaattgcctgcaatgcttaagaaacccaaagatgtcctctaaagaatgaataaaaccaaaagctatattatgcttttacaaaagtgggggtgggatttttataaaagtgggggtggggtttaaaatcaagccaataccatgtatgcaaatcacattgtctgccaactccaacctcattcaagccattctggtgagtataaagctgactgtgggcctctgcttgggcctctgcttctcctacagatattggagtgctgtgctttctaattttcccaccctttcatgaagtcgcagtctctacagatggttttccatttcagttgtttgtgggccatcaacctacaaaatgtatttatgaagaaagccagactactcccagataaatagtctttttcttttgtatctggataacaagagatttctgctggcttccatctctgaagaaataccacattaagagacttggcaagacttgtgaaacacaagaacaaaattttctatagcaataaaatgtttctctgaagtgtagttgaacacaatacaagatcccactacataagcccacagaggccatttttcagtggtggaatgctgtatgccactggtccccaatgcacaacctagatccctcacatgtgcagttcacaatgggttcgcgctcctgtgagaatctaatgccaccactgatctgacaggaggcggagctcaggtggaaatgcttgctcacacaccactcaccttctgttgtgcagcccagtttctaacaggccatggaccagtacgtgtccttggcccaggggctggggacccctgctgtatgctgcttttgttttgttttgagacagggtgttgctctgtcacccaggttggagtgcagtggcttgatcatggctcactgtagcctcaaactcctgggctcaagcgatcctcctgcctcaccctccccagtagctgggactacaggcacacaccaccacagaatactattgttgaaggaccaagtcctgaaagtcttttgaagggtatgcgacagcatcagctgtaaaagatggggcctgaaaagctgttttggagcctgaccacaggctttgcctgggatccctcaattgggagaagcagcctggttctatgatcaactgagtaaacaacctccagaatcaaagtgcagaggattatgatcaaggaatcgtctctgagtgatagaagtttttagaaggtattgacagcactcaagaggttgagggaggggagtttaggggaatacaggatggtaactgcctcttgagaatcagtagctgttttttgcaggggtctgaccagggagggatttcaggtagtagagatggcctagttatcagtattttacatattaacaagtgtaaggaatggaggaaagagagaaatatttttgaaagaacaattaaagggttgaaaaatatcttaagatataaacatctctagtacaatgacagaaataatgtttgaaatcttacctataacatgaagtatgttgaagagactacaaagtaagctttgagtatcttgttgctgtggacacggaatgtgtgctaggattagaagttgcctaatgacaaaatatgagcaaagtaagataattgccccctactaatatccactgaactgcaaaacagtgtcaagattattaccctctctagtctttttactggaaaatagggtttggcaatttttgttttaatataataggtgacattgccaacattgatatgccagcactcctttgagctgtagcaaaagctccttcaccgatttcaaatttgggagcaggtccaatgccttttttttttttttttttttgagatggagtctggctctgttgcccaggctggagtgcagtggcgtgatctctactcactgcaaactccgcctcccaggttcaagcagttctgcctcagcctcccgagtagctgggattataggaagcgccaccacgcccggctaatttttttgtattttaagtagagatggggtttcaccatatttgttttgccaggctggtcttgaactcccaactccaggtgaaccgcccacctcggcctcccaaagtgctgggattacaggcatgagccaccgcacctggcccaatacctcttttagtgcatttattaaggtgcttatacctattttctaaccagtcaacttatggctattcagtaaatgaacattttttcatttctaacaaaggaaaatgatactaattttcaaaatgaacttattttgggttcttgtgtaggccaataagctagcccataactgcatcatgagcttgttttgttcaaccaatatttaactcaacatctactgtgcactaagtggagataggataacagtgaccacagtaggctctgctttcatggatctcatattcttcatgaaaacagaaagctagaggtcgttaacatgctgcatcagcatcgcatcccactaagaagtatctgctccttattactttggcagatctttgtttgttttttctttatatttcaaaattcattctaggctgtttgcaacaattaaatccaaagatagctttaaaaccactctccaaacaagttattttggagtttttgacatactatcttgtttcaaatggctctttttaagtcaatagaattctaagttggttggggaaagatcctaggctactgtatctaattctgttttcatcactcaagttttattatttaaaaaaaaaatagaggaatccagtttttcaatttcaactatgtcattagcatgtacttccatattctccattttgtagggagtaacattttacattactttttgtttgctttttcttttcttgagacagtcttgatctgtcgcccaggcgggagttcagtggtgtgatcttggctcactgcagcctccacctcccaggttcaagtgattctcctgcctcagcctcccgagtagctgggattacaggctcaggccaggtagggagggatatgctacatgcccactggcataaaatatcccatatgtccctcaaaaggaaaaatgatcatctgttagtttggggacttaaaaaaaaaacctgacatcactgtgtattaccaaatcatgagatgatttatacattaagctacagagaatcatatgccaaatgttattcagttaaagttttattttgaaataatttcagacttacagaaaagttgcagattttacagaaagttctatatacccctcatccagttccctttataataacatcttatattgccataggacatttgtcaaaactaagaaaccagctttggtatgttgcttgtaactaaacttaagagtatttagattttcaccaatgtcccttttctggtccaagatgcagtccatgatactacattgcatctaaggaatcatttccttagtgtcctctggactttgacagttttttggtctttttcatgactttgacaattttgaggagtaataatgggacattttgtagaatgtctgtcaatttgtatttgtctggtgtttttctcatgattaaagtggggttatgtattttggataaaaataactgtatattgtaatcccagctctttgggagaccaaggcaggaggattacttgaagctaggagtttgagaccagcctgggcaatataggaagacccccccatctctacaaaaatacttaaaaattagccaggcatggtgatgcacacctgtagtcccagctgctcaggaagctaaggcaggagaatcacttgagcccaggagatcaaggctgcagtgagctatgatcatgccactgcatttcagcttgggcagcagaatgagaccctgtctctaaaaaataaaaacacaaataccatataaatgaagttctcttctcatatatcagcaggtacaagatactcacatgataactttatttggctaagttggtgtttgccaggtttctctatagttacttttctttcccccctttcttactctagtctatatgaaagccagtcactaaatccaacccacacttgggaagagagatgggagtaagagagaattaagctttacttcctttctagagtgggaagcgtctacttaaattatttggaattttcccacaaggaagatgtctctcttctctatttgtttgtttagtcactcatatgtatttatatgtgtgtatgtataaatgtacacacatgggtatgtatatatcagtatgggctcatgtatatttcatactttgaattataacccaatagtacatgattttgttgttcacattgttccagctttagccattaggggctctttcaagttggcttatgtgtcccttgacattccctgatacttttgtttttagagcacgtactttctgccatcacaagatgccacagacatatcttgtattttccctgcctcagtcctagaatcagccatttctacaagaatccctggtttcttctaggagaatgggatttagaaaccaagcttttactcactgggtttgcatgttgctattggggcatctcagcctcttggtctgccaacattttaaacttcattttcttgccaggcgagtaagctgctttcacatggagcactatgaccattagaaaacatagttctgggctgggcgcagtggctcacccctgtaatcccagcactttgggaggccacaataggcggatcatgaggtcaggagatcgagaccatcctggccaacatgccgaaacaccgtctctactaaaaatacaaaaattactgtgcatggtagcgcgtgcctgtaatcccagctacttgggaggctgaggcaggagaatcgcttgaaccagggagtcgaaggtttcagtgagccaagatcacgccacagcactccagcctgacgacagagcaagactctgtctcaaaaaaaaaaaaagaaaacatagttctggtgtgtgtgtgtgtgtgtgtattactttgggccaagcgcagtggctcacacctgtaatcctagcactttgggaggccgaggtgggtagatgacttgaggtcaggagtttgagaccagcttgtgcaacatggtaaaaccccatctctactaaaaacatacaaaattagccaggtgtggtggtgggcacctgtagtcccagatactcgggagactgaggcaggagaactgcttgaccccgggaggcagaggttgcaatgagccaagatcccaccattgccctccagcctgggtaacagcaagactgtctaaaatataataataataaaataaaacactctggtacccaaaagactcaagcctatagatacttcattcattttctgctcatcttacataggaaaaagtagagggccaggtactgtggctcacggctataatcccagcacttcgggaggccaaggtggccagatcacttgaggccaggagttcaagaccagtctggccaacatggcaagactctctctctactaaaaaatacaaaaattagttgggcctggtggcgcatgcctgtaatcccagctactcagaaggttgaggcacgagaatcacttgaacctgggaggcggaggttgcagtgaaccaagatagggtcactgcactccagcctgggtgacagagtgagactctctcaaataaataaatcaataaatattgaactgtttctctctttccccattatgattatttgttttaatttcccttagctagtaatatttagagtctactaaggtaccaatacagagcagtgttaaaatgttaactcagttaaacaataataatggaaatcgcgaaataatgaaaagttaactgatgataaaagcgctgcgtatcaaaacttgagataaacctaaagtaagcccaagagttcgaggttacagtgagctttgattgtgccactgcactccagcctgggtgacaagagttaagaccctgtctcttaaagcaaaaaagctgagtaatacttttaggtaaatgtaaagtctttaaatacatttgtttagaaaccataccagtttaaagtaaatgaattagggtatcagaagaaccaactgggggcagggggatgccacctaagtgaatatcaagagtttactcttccttctataggaagaagttgtgtgctgagaggaaggaggtatagactagaattgggagatctgtgctctaatgctaacattgctgttcacggaatatttgactacctgcttggtatgggccttcctctcttctctagaaagggcttactcttgccaaccatatgagcacatccagaatcactttaaatactgcctaccaagcttaacaaagacaaaaggttttggtaataataggatattaccagcttttcaatgaagtaaaaatatcaagaatttctgaaatttcaagtcaccatgagttgaacttgtactatcagtattccttttcaatccttctgtcatatttacctcttattggtaaatacatgtcctctgacctgaagtcctgggaaactatctttgccaaatttcaaaaagccaccctgccatagcttcttcctacattgtagaataaatagtgctcaacactggctgtgtgttagaagtacctggaaagcttttaaaaatacaaatcctggagccccacctcagactaattatttcaggatctctggggatgagacctgggcatctctctctctctctctctcattttttaaatttaaattccttaggtgatcataatatgacccagggttgagacgacactgaaatggtgaaaataacctgattcagctaacaatatagataacaatttatattttcaggtatttcagaaatatattttaactgcaagatgttggacaaacaaatggacttacatatggcacatactttgaaaatacagtgttaggagagcatataatggggaccctgtatacactgggggattagggaatgttgcccttaggagtagaattttaaacaaaaatgtgaagaatcaaatagttaaggggtctgttgaaatagaggagatcttgtgtgcaaagtccatggttgggggaacgcatggtgtatttgagaatgaagaaagggtgacagtatggcgagagttcattctcacatgcaaaagtcaaatctgaacgtgcccagtgacaaattaatccagacaaactttttctggacaaatagagggaaagaaccttttttttttttttttttttttttttttttttgacagagtcttgctctatcacccaggctggagtgcgatggcacaatctcagctcattgcaacctccacctcccggattcaagcgattctcttgcctcagcctcccaagtagctgggactacaggcatgcaccatcacacccggctagtttttgtatttttagtagagacggggttttaccatttgaccaggctagtctcgagctcctgacctcaggtgatccacctgccttggccttccatagtgctgagattacggcatgagccactgcgcccagccatggaaagaacttttgaaagctgccttatactttcacttagcagaattcactagagatgaactttagttggtttttttaatagttactcagcaaaaagaataacgatgctttcaatcatttccaattcgcaattagccacacagcatgttagaataactgtaggctctttggagtaactagttatatctaacctcagggttagtcaaagtatgggccttggactagcagcatcaacatcacctgtgagcttcttagaatgcaaattcacaggccccagcctactaaaaccgaatctgaagagatggaagatcccaagaaatcgctataagcgcttcagatgatttttaggcacactgaagtttaagaaccactgcctaggagtatttcacatctctgccagagtatagtcctcttcaaaaagctaacacaaaacaagttgtatgctgcttttagaacctttcggcttgtactttcgcatctacaacacagaaacaataagcccttcctgatttccttagtaaactaatagtaaattaatttcctaggcaatgcaggatggcatctaattggtcttcatactaggcttctgacatgtaaggtggtgctgcttccttttaccaggtagggaactgagtaacacagaagtcatgtacctagcaagtgtcagaagcaagactggcacttggttttctgggaggcagtattgtccgaaaaataactctcaccaccaagagttttcttttggggaaaatgacgtagtggatatagtttggaatattggcattggaaaaataggagcattagtatagccctgctggggttgctgaaacctcggcttccatttatttatttatttttttatgagacagggtctcactgtcgcccaggcagtagcttagtgctgtgatctcggctcattgcaacctgtctcctgggctcaagggagcctccagagtagctgggactgtggctaattcttgtattttttgtagagatgggttttcaccatgttgcccaggctggttttgaacacctgagctcaagccatcaacccaccttagcctcccaaagtgctggggtcgcaggcatgagttactgcgcccggccagttgcctcatctataaaacaaaagtaacatccacttcatggggttgtcttgaggaattaaaggagatcggataaagtgcccagcattctgcctgaaatacctagggcccttcctgtctgcgtccagtgttctttttctgccacactcttactaccttagtcataatcagttacatacagttaggctatgccattttcagaactgtaggagattatagcttacctatccacatttctttctttttttttttttttttttttttttttgagacggagtctcactctgtcacccaggctggggtgcagtggtgtgatcttggctcagtgcagcctccacctccggagttcaagcgattctcctgcctcagcctcccaagtagctgggactacaggcatgcgccaccacgcctggctaatttttttgtattttcagtagagatggggtttcatcatgttggccaggctggtctcgaactcctgacctcaggtgatctgcccgcctcagcctcccaaagtgctgggattacaggcgtgagccaccgtgcccagcccacatttatttaatattctattgatcaaatttttaaaattgttttactttccctagaaaatactatgaagtctttttttttttttttttttgagacggagtctcgctctgttgcccaggctggaattcagtggcaccatctcggctcactgcaagctccgcctcccaggttcacgccattctcccgcctcagccttccgagtagctgggactacagacgcccgccaccatacccggctaatttttttgtatttttagtagagatggggttttacctatcatgttagccaggatggtctcaatcttctgacctcgtgatctgcccgccttggcctcccaaagtgctgggattacaggcgtgaaccaccgtgcccagcaatactatgaagtcttaagtgtctatccctactgctaacagacctgggaatagaggcttttagctcccacttctcctgggattcaatagaacattgcaaaatccttttttttttttttttaacacaaggatcaatgcttagtgtccttttcaagttgtttattgccctacctagaaagaaaatgactattttcctacaaaatcataatgaactcctaaaaataccaggtacttagaaatgcatgttctgtcacatccagctctggctttgttcctaatttaggggatgccaactactttgggcaaagagacagctataccaaacaagctggctgctcagaataaattctaggccgggcgcgatggctcacgcctgtaatcccagcacttcgggaggctgaggcaggcggatcacgaggtcaggagatcgagaccatcctggctaacagggtgaaaccctgtctctactaaaaatacaaaaaattagccaggcctggtggtgggtgcctgtagtcccagctacttgggaggctgaggcaggagaatcgcttgaacctgggaggtggaggttgcagtgagccgagatcacaccactgcactccagcctaggcgacagagtgagactccatctcataaataaataaataaataaataaattccagctttttcttattaagtgtcatagactcaaccagcagagtgtaaaacagagacacaaagattaggataatcatgtgggggtttcttcttgctcaaaatgttttatcttttgagaagagcaggaatatcaccaataaaatgtcaggttttaaagttgaacaatcctgggtcttgatatacatggttctcaagaattatgctactaattccaaagtttggatggttgaaaatttacagccttgtgcaagtgtcttaagagtactcagagccagccaggcgcggtggctcacgccagtaatcccagcactttggggaggccgaggcaggcagatcacgaggtcaagagatcgagaccatcctggccaacatggtgaaaccctgtctctactagaaatacaaaaattaggtgggcgtggtggcgtgtgcctgtagttccagctactcaggaggctgaggcaggagaatcccttgaacccgggaggtggaggttacaatgagccgagatctcgccactacactccagcctggcaagagagcgagacgccgtctcaaaaaaaacaaaactcagagccagtatgtattggtttttgaaaagtttgcattttctcatcaccatgcagttgcgttttgatttataaaaggaaatgatccttttcatcaccatctttttaaaactcttttcgtctctttattttttaaataaatggatccaatttcgtgattctgatttttaaaattcaatcttattcccaaccacagattttgactcatgttttcctttaaattactggttgtttttttgttcttttgagacggagtcttgctctgtcgcccaggctggagtgcagtggtgggatctctgctcattgcaacctccgcctcccaggttaaagcgattctcctgcctcagcctcccgagtagccaggactacaggcgtgcaccaccatgcccagctaattatttatttatttatttatttttgaggtggagtctccttctgtcacccaggctggagtgcagtggcatgatcttggctcactgcagcctccgcctcctgggttgaggaggctaattttttttttaatttttagtagagacaaggtttcaccatgttggccaggctggtctcaaactcttgacctcaggtgatccgcccacctcggcctcccaaagtgctgggattacaggtgtgagcccccgagccaggccaatttttgtattcttagtagagacggggtttcaacatgttggccaggctggtcctgaactcctaacatcaggtgatccacccacctcagcctcccaaggtgctatgattacaggcgtcagccaccgtgcccagcccaaattactggttttattgaaaagaaaaatattcccctttacacttaaactttctccaactactccgtatctacaaaacaaatgtcctagggtagccaacttggtttgctgggacttttctggtttaaaaactgaaagtctggctggttatggtggctcacgcatgtaatcccagcaatttgggaggccaaggcgggtggatcacaaggtcaggagttcaagaccaacctggccaacatggtgaaaccccgtctctactgaaaatacaaaaattagccaggcatggtggcacgtgcctctagtcccagctactcaggaggctgaagcaggagaattacttgaacccaaggcagaggttgcagtgagccgagattgcgccagtgcactccagcatgggcgacagggcaagactccatctcaagggaaaaaaaaaaaacaaacaaactgaaagttcaacccccaccctaccctcaatggataaactgggacagttggtcaccctggatgtcactgagctgacactaatttctggtcaccctcagaggcctggttgccctgcaaagaagggaatcctcctgcaaagatttgcctgtaaagccacaaagcaggagtgaaaggggaggaacagtgctgttagtacatttacttcacattacaccatcaaaacaaaactggatatattctgcttttagtaaatctggcaagtagtgtctcttcagtctaaaaagcggctggtttgcctctggcattgaaagcgggaaaagacctatcaacacaaatcccagaacctgacatgaatacaggcttgaaagcaagttccctgaagtttccctgaagatggcgggactaagtactttactcctcttggttttagattccatccctatggaaagactcttgtaataacattctcaaatgtttctgttcccttgagtgctgaattgtaactctactcagtatgtcagatgctacaaactcaaggataactattatttaaaacttctatcctcaaaatgataggaaatttttggcacacttttcaaactccctcaggtaagagctgtaggtggaaaagttgactcccactgagcgctgggtggaggctgctgacacctataggatagagtttctctaactgaatggcagaattaacttttaaaaatgcagttggcattttaaaaaaatagaacatacaaatacaccttaaggtaaatgttatttagtaaaacattttggcttttatatatagtagtaccccctatattcgcggtttcacttttcgaggtttcagggaccccacagttaaaattctttggtagagacctacagtttcaccattttgcccagactggtcttgactcctaggctcaagcaatctgccagcctcagcttcccaaagtgctgggattacaggcatgagccaccgtgcccgaccacagttcaaaaatattttgagagaaccacttccacataacttttttaacagtacattgttataattattctattatttattgttgttaatcttactgcacctaatttataaatgaaactttcttacaggtatgtaggtataggaaaaaacatagtatatataaggttttgtactatccgtggtttcaggcatctactggggttcttggaacgtatcccgcatgggcaagaggcaattactgtactgattcacaatcttttatccaaaactgttgggacaagatgtgtttcagaattcttcagtttaagaaaatgtttcaaagttggatgactgctaggctaagtggagttcaagctattgtcaccagtgaatagagaaaagtgcaacactggcaagggaggatccaagggtgttcctgcctttaaaccaacatcttggccctcaggtaacactacaaaaagtaagagaaaatcactgggagtgggagagtcatattaaatgtttttatcagcctccatttcttgttaagcagtataaattgttccttctcctaccatccctttccaagctgcagctaagttagggactgtttccagtccttctggctggaaaccacaaaagtcaagtaaccttcacccctgccaagaccatacattctgatgagatccaagccctggcctggattttttgttacttctgtgtgaaattgcaatccaccagacctgactcatggaaagaatacagatcagctgggctaggaacagaaacctcctcttcccaccagccaatcaagaattattcttcaagtgttggccaggcacagtagctcacagctgtaattgcagcgctttgggaggccaaggttggaggatcactggatcccagttcgagactagcctaggcaatatagtgagactccatacaaaataaaaaaaaacttaactgggcatggtggtgggtgcctgtaatcccaactactcaggaggctgaggcaggaggattacctgagcccaggagttcgatgctgcgattgtgccactgcactccagtctgggcgacagaataagagcctgtctcaataataatttttttaaaaatttatttgactgttaacagcgcttttagaattcgttttctgatttttaccagaaaacccccatggggggaaaaattcttcaaacctgtccttgttaacacaaggtggtatgtaagtaaaataggtagatatatctttcgatgctcagcccagtgactgtgatgtcatagctctggtctggaatattcttagaatctgaatctgcagttgctttgtgcgcagtggctcatgcctgcaatcccagcattttaggaggccaggcgggtggatcatctgaggttaggagttggagaccagcctggccaacatggtgaaaccccatctctactaaaaatacaaaaattaggcaggcatggtggtgggcacccagctactcgggaggctgaggcaggagaatcgcttgaacccgggaggcggaggttgcagtgagcccaaatcatgccactgcattccagtctgggcgacagagcgagattcttgtctcaaaaataaataaataaataaaatttgaggaacaggaaaaaaacaaaaagcaaccaatctattaccttcacaacaggctgtaaagtctgcaaagctagctttatgctaaagtttcaacagggacttggcctctgaaaaagtgggtgttgaaaattagagatgatacagttagattgtgaggacttcttaacgcttgcactcctagttcacaaaccactaggtttcctcatctttctgggactccctaggcaaggactccctgagaatggatagccttgggcagaactgtgaagtcatcacagacagcccctcatttactcctttctctccccagaagttcctaccctagtcagacctccggggttcttatcttccgatccatccggaaagaggtttaaagtaggaaatctcaattatcactttaaaagtgctatagaagaatggctgggagaggtggtgtgcctatagtcacagctgctttggagactgaagcaggagaactgcttgagcccaggagtttgagtccatcctgggcagtacagcaagaccccatctctaaaaaaaaaattctaggtgctgtagaagagagtgaagattaaaccaaaggaatgaatctctgagtggcagaacttcagggactttgatgagtgtgggaggtctctgagtgagagggtcttcccagtgcctggaagctcagtctttgatggcagccttctctaatacaccccataagagctgagctgctcttctaaacttgtcaaggtgggtctttccaccaatgcagtttgtttacctttaggtaaatggtacaaaaatcatcatgtaattgttggctgggtgtgatggctcacgcctgtaatgccagcactttgggaggctgaggcgggcagatcacctgaggtcaggagttcaagaccagcctggccaacatggtgaaaccccgtctctactaaaaatacaaaaattagccaggcatggtgatgcacatcggtaatcccagctacttggaaggctgcggcataagaatcacttgaacccaggaggtggaggttgcagtgagccgagatcccgccagtgcactccagcctgggtgacagagagagactccatctcaaaacaaaacaaaacctattacataacacacttcaatgatctgtgactagtatagcttaaataaagccaagtgaaataaactataaaactatacccctatggaatcttttgattcagaggcaggtacatacaaaaatcaaaactggccagatattaaatattacattgagcaaaggtaaagtgctttaactaatagacatgtacaataaaaatttcagattcctgagtagaaaactttcaacttcagtcttcagtaagtggtagccttaatgcctgcccgtgtgtgtgtgtgtgcactctcttgtggaaaaaaatgtgtttcaggatttttcctcctttggtgttcatgtggtgaacaacaaagtaagattgattttttgttgttgttttttgtttgtttgtttttgagacagagtcttgctctgtcacccaggctggagtgcaacggcacgatctctgctcactgcagtctccgcctcccaggctcaagggattctcccccctcagcctcctgagtagctgggattacaggcacccaccaccatgcccagctaaattttgtatttttgtagagacggtgtttcatcatgttggccaggatggccttgaactcctgacctcacgtgattcccctgcctgtgcctcccaaaatgctgggattacaggtgtgagccactacgcccagccttgatttttttttttttttttttttttttttagacagggacttgctctgtcggacaggctagagtgcagtggtgcaatcttggctcgctgcagcctccgcctcctgggttcaaggggttctcctgccctcagcctctcgaatagctgggattgcaggcacgtgccacacgcccggctaatttttgtatttttagtagggacagggtttcaccatgttggccaggctggtctcgaactcctgacctaggcctcccaaagtgctgggattacaggcatgagccacgacacccggcctgattgatttttgaaacaccttgttgcccacgctggagtgcagtgtcatcatcacggctcactacagcctcgaccacctgtgcttaagtgaccctcccatctcagcctcccatgtaggtgaccacaggcgtgtgtcaccacgcccagctaatttttttttttttttttgatatggagcctgtcacccaggctggagtgcagtggcgcgatctcagctcactgcaacctccctctcctgggttcaagtgattctccttcctcagcctcccgcgagtagctgggactacaggctcgtgcaaccatgctcagctaattttttgtatttttagtagagacggggtttcaccgtgttagtcaggacggtcttgatctcctgacctcgtgatccgcccacctcggcctcccaaaatgctgggattacaagcttgagccaccgcgcccggcctaatatttttatcatatatagaaagggggtttctccatgttgctccagggtggtcttaaacctcctgggctaaagagatcctccttttgggaacctaggcttcccagagtgctgggattacaggcatgagctaccgtaccccaccaagattgttttgagacagggtcttgctctctctgggtggagcgcagtggtgatcatagctcactgttgcctcaaatcctcggcttcagcgatcctcctgcctcagcctcccgagtagctgggactaaaggcctttgccaccattcctggcttatttatttatttagagatggggtctaattatgttgccctggctggcctcgaactcctggccccaagcctcatgcaatcctcccacctcggcctcccaaagtgcagggactacaggcgtaaaccaccatgctcggcctaagttttgttgttgttgttttaagcaaaaatctgtggaggaggaaacatctcccagtttgctctcatctgagtctgcttcttacatgagatgggtctaaagacattttagggtaaaagaagaacggtaggatgttttaaatgtacgaatacataaaaatggaagtctttgaaaaggaagacaacagaaacgttaacaacgaagggagtgagcagaatgaagaatggcataaaagagcaaaaccccttctgaacagctggaatatgacaccagagtactaaagactggtaatgccatcaggatatgaatgataacgcacacctcgtaaagaattttttatgctggctgtgaaatttgaactgatagagtggggtggctgtggcagggaaagctggtgagacaattatgctaatggcagggccagacgactgggtgagtgcttaaatggtgtcgtaagtctttataaaccttggcacatacgtttgagtactggtcatctactgtaagcttgggacaattctactggtatttccttacatttattacccagtccctcccctgtcccccaacacctgaaactttaaaaacaatctttccaaactagctttgaagagctgtacttttccttcgtatgtacgttgtttaagtacgctgatagcaacgcaatatgacaattcaaagggaatcccgtcttctaatctcagggttttcattctggggaactctccctgcatgtgaggattagggagcccggaaagcccgtttcaacttttcagttctgagtcccgagtcactactctgccctgtaccgtctggagacttaatgggagcgagtgcgaggcagtgaattctccgctctctagttttccaattctacggtcttcaaaaaaaggtttgctcttgagctgcgcctaaactgagaagcgggaaaggctagccccgctaaaggcggacgagtggcagaagcggaaacccagttaagagaagggactgccctggagagcacagaaagcgaaggttagcgggggaaagcggcgcccctccgaggaaaccgacaccgccccgccacgccaaggcaatgggcgccaccacgcagcgccgggaacgcgcgccgacgccccgcgctccgccggcgtccgcccgtccccgcgcgccccctcgcaccccacgcgcgggaggcggggccggcgggggcgcgcgcggggccgcgggtaggggggcggggcggcagagctcggcggctgggactggaggacagcggtggcggaggcgactagcggcggcgggagcggcgccgagaggccgtgcgggacgcgggcgccaggaccggccgaacgcagaggtaacgcaggaccgaacaggcggccggggagtgggcgcgggctcgctgggccccgaaggcgagtggcggaggccgctcgcccggggcgccgacgccgctcccagagaggagggggcggggcgcccgggtccccggaggtggcgccttttgtctgccttacccggccgctccgccccgctcccttcctctctcctgcgacctagccccctgcccttttggtggactcctcctcaggggccctccggcgcgcgcgctcccgcccttgttttgtttggatttgggggaggagggggagctcttctctggccgtgcgaccctgcgtcccagcgcgcctgcgtcggcgtcctctgcccgccccgattggctgagggctgcgcatgctccgaggcccgccgcggtccggcgtccgcccgcgccctcccctcaccccactccctcagcggttttcggagccggttcgaaagatgccggcggcggtgactggctgcggcgggcccgccccccgggttctccgcccccgccgccgccattacggagctcccagtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgc

SEQ ID NO: 1762 - DNA, 219744 bp, Homo sapiens
  SSBP3 gene - 54404174 - 54583917 of chr1; NCBI Entrez Gene ID: 23648; Build 35; sequence includes 20,000 bases upstream of initiation codon and 20,000 bases downstream of termination codon of the gene
aaaataaaataaagtaaaataaaaaataaaaataaaaattagccaggcatggtggcacacacctgtagtccagctacttaggaggctgaggtgggaggatcacttgaccctgggaggtttaggctgcagtgagctgagatcacaccactgcactccaggctgggtgacagagtgaaaccctgtctaaaaaaaaaaaaacttaatgaaaaaaattcaaaaccagatgactgaaaattatttgctgtgcctcccatcaagagatgtggtctacatcccctttttcgaaaccctgaaatctggtgaagctgtgctgctgggaccactagagtacagtagaagtgacaaggcatgacttctgaggccaggtcataaaagttcatgcagcttccactttggtttcctagaatattccctctcaggactcaggactctttttttttttttttttttttgagacagagtctcgctctgttgctcaggctggagtgcagtggcgcaatctcacctcactgcaacctctgcctcccaggttcaagtgattctcctgtctcagcctcctgagtagctgagattacaggtgcccgccaccacgcccagctaatttttttgtatttttaatagagacggggtttcaccatgtttgccaggctggcctcgaactcctgacctcaggtgatccacccgccttggcctcccaaagtgctggaattacaggcgtgagccaccgcaccgggccaggactctcctttttgaaacccagctgacatgcagtgaattgcccaagccacaaggagaggccataatcccacctgagcccaactttcaactcatccgaattcaggcatcagacatgtgagagaagaagcttccagaagattctttctctgaactcttgtagtcttcccagttgaggccccagacactgtgcagcagagaataaacatccctgctgtgccccgtccaaggtccaaagaatccctgagcacagtcaagcggctgttgtttacaccactacgttcagggtggtggttatgcaacaatagtacctggaataaaagcaatttctcttataaaaatatacacatttctggccgggcgcagtggctcatgcctataatcccagcactttgggaggccaagacaggcggatcacctgaggtcaggagttccagaccagcctggccaacatggtgaaaccctgtctctactaaacataaaaaattagccaggcatggtggcacgtgcctgtagtcccagctactcgggaggctgaggtaagagaatcgcttgaactcgggaggcggaggttacagtgagctgagatcacgccactgcactccagcctgggcgacagagcgagactcagttaaaaaaaaaagtgtatatatatacacattttaaaccttttgactatttagaaaatgctaaattaaatcacagtgctcgtaaatgttgagaaaaaaaactacattaagactttatagcttaatacaagaagacatgttgactcagaaatgacttccatgacacagtggggaaggtgtatgtctgggctgctaccttgaacaatcttactgacatgtctgctttagattgggttccctggaaaccaaccctcattcagagagttgtggctcaaagtttttggggaagtgctcttagaagatgtgcctggaaggcaggtaagaaggcaggactgggcagaggcagaaatcgaccttcaatggctgtcattaaggcctcagctgatcccacagaatgccctagagctgagatggcccttcagatgtgtcctaagtaggctggctgtagtggcctatgcctgtaatcccagcactttgggaggccgaggcgggggcatcgtttgagcccaggagctcaagaccatcttgggcaacatgatgaaaccccatctctactaaaaacggaaaaattagctgggggtggtggcatgcacctgcagtcctacctactcgggaagctgaggtgggaagatcacctgagtccaggaggtggaggttgcagtgagctgtgattgtgccactgcacaccagcctgggctgcaaagtgagactttgtctcaaaaaaaaaaaagaaaaaaagctgcaggggccgacacggtggctcacatctgtaatcccagtactttgggaggctgaggtgggaggatcacttgaggccaggagttcaagaccagcctagccaacatggtgaaactctatctctaccaaaagtacaaaaattagccaggtgtggtggcacatgcctgtattctcagctactctggtggctgagacaggaggatcacttgaacctgggaggtggaggctgtagtgagctgagatcaagccactgcactccagcctgggtgacagagtgagactcggtctcaaaaaaaaaaaaaaaggctaagttgaagcaagggcagccagctggccattgcacctccacattagccaggcatgggccatgagccacccgctgggagggggcataaccttgagtaaggatctctgcagctgaggaaattccttgtgagagatacagttggcgttcaaccacagccaatattccaagcagcttaggatgggtggctcagccagaaggggatctaggcagagaatcagagtagccactacagtccaacccttgcactgctcctttccatttgcttctgtgaagtttgacccatttgggaatggcttctctaggtttctggttgggtttgtttcctgtgaaactcaaaaaagaagggttagtgagatgaactgtagaattagttgcagaagttgatctcaagactgtaatagatacttgttatcacactcttctactacctgtcctagattccccttaccttttgctagcatttcttattttttttttattttttatttttttgagacagagtctcgctgttatcacccaggctggggtgcagtggtgtgacctcagctgactggaacctctacctctgaggttcaagttgttctcctgcctcagcctcccaagtacctgggattataggtgcccaccatcatgcctggcaaatttttttttttttttttttagacagagtctcactctgttacccaggttggagtgcagtggcgccatctcagctcactgcaagctccgcctcctgggttcacgccattctcctgcctcagcctcctgagtagctgggactacaggtgcctgccaccaagcctggctattttttttgtatttttagtagaggcggggtttcaccatgttggccaggctgttcttgaactcctgacctcatgatccaccctcctcggcctcccaaagtgctgggattacaggcgttagccacagcacccggacttgctagcatttcttccgatttgggcagtttgtctggtggagatccagatcctcaaccctgaagggtccaagccccaggttactgtgccctgcttaagccatggctgctttacttgtccatgtaccaataaagccaggcacagtagcaccagaagaccccccagtgcatcgcctgagcatgactcatattcatctctgttcctattatttagccacataccctacctcctactgatgaccggggtaattatcgccaacattatggtgattcctttccttgctgatggtctcttagctcaatacattcaaaagaatcaagaagcagtcatagtgtaaaattcaaaggaacttctactgtgtccccaatggaaatattccccctctcggagctctagatctgcagagctttgtgttgcagggataggaagctccccttaaagatggtataactttggataaagtcattccctgcagccaaaggcaattcccagggaacaatgctcctgtgaactgttagcagccaatacttccagaagctgatgagcgtgttggccctagagaggacatcttggtgaattacaaccccagtatccactgcaacatctgagattcactttcctaaccataaaatgggaataacaatggcttattggcatggtactgggaaggaaatgagataaatgataaatgagataatgtatgttaaaaattctggaaaaaaaattctgtaatcccagcactttgggaggctgaggccggtggatcacctgaggtcaggagtttgaggccagcctggccaacgtggcaaaactccgtctctactaaaaacacacacaaaaaaattagccgggtgtggtagtgcatgcctgtagtcccagctactcaggaggctgaggcaggagaatcgcttgaacctgggaggcggaggttgcagtgaaccgagattgtgccactgcactccagcctgggcggcagagcaagactccatctcaaaaaataaaataaaataaaaataaaaattttggaattgtaatcaacaaatgttagttatgtcaagagctccataaagtgatcatgcttccttttttgccttggccagcagggagcttatagcttcatctggtgcacattcacagaagatatactgctcattttcattctcttcttatttccttggttctcctggtttcttcttcttttttctttaattaaccttacacacaatccttttgttgcaatctctttgaactggaatcatttttgcagagtggcaggggataaataaatgcctagcagagggacttgctgctctgaagacagttcattttccaagaagtaacaatgcctcacctagaacaccgccccagcaccttgttcaaacctagccaagcttcacgactgggtctttgatttgttttggcatctgccaaccaactggcacctaagcgtgggaatccctccatgcagagggtgactcacagctctgacaagttggaaaaatacaaagcaggtaccaaaaatgggcggggggtggttagtgttatcaggcactcccatcagccaaagacactgctggtaatctttattcctgccctccttccagacttcccacccttctacccacccgcatatggctcagttagtagtctcaccctactttgggaattgagccatttaggggacagagacatagcagagagatgagaaggtagagagggactggagcatatgtgacccagatgttatggctgagcttggtcctcccacaccaggctgcccatcgggtttggccctgacctcaaggcatctggaggaccccgtcatggagtcagaaggccccagatgggccagctgggttctctgccttgagatctcttcaccatctccaggctaatcctgtgagctcccacctcccccgcttctctccctccataggaggccttggaatgccagtggggtgccatgtctactattatttcatgtaagtatataagatgaaccacactcatcaataacacttccctggaaatcatgttagcaagcatgcttgctgaggggtttcaaatgtcccactgttcacggcttttggctccatcaccagttgtggttccatggcatgttcaggagtaggaagagcttgagatgtccagtgttgagtttcccagggcaggggtcttgttcttgcaatcacatctttgtctagtaagaacaagcacatgagcgtgttcacggaacccttatgggctgggacttggatttcaggttctgggggctctggaagggagagagaaggtcaaaacagtgatgacgctgggtaagaggctggagttgggatgtgtagattccaatcctagccttgctgcctactagctgggtaacctggtaaattgctcttcttcctctccaagcctcagcttctcccctggaaaatgggtgacataatacccacctttagggttgttgtgactgccaataaaacagcattttattggtacagtggctcacgtctgtaatcccagcaatttgggaggccgaggccggtggatcacttgaggtcaggagttcgaaaccagcctggccaacatggtgtaaccccgtctctactaaaaatgcaaagattagccgggtgtggtgacacatgcctgtagtcccagctacttgggaggctcaggtaggaaaatcgcttgaacctgggaggtggaggttacagtgagccaagatctcgccactgcactccagcctgggcgacagagcaagactccatttcaaaaataataataatgataataataataatatttagaggctgggtgcagtggcttatgcgtataatcccaacactttgggaggctgaggctgggggatggcttgaggccaggagtttgagaccagtctgggcaacatagtgagactcttcatctcttctgtttttcttttccttttctttttctttttttttttttgagacagagtctcgctctgtggcccaggctggagtgcagtggcacgatctcggctcgctgcaagctccacctcctgggctcatgccattctcctgcctcagcctcccaagtagctgggactataggcgcccgccacgatgcccggctaattttttgtatttttagtagagacggggtttcaccatgttagccaggatggtctcgatttcctgacctcgcgatctgcctgcctcggcctccacaagtgctgggattacaggcgtgaaccactgcgcctggcctctttttcttttttttagagctagagtctcactctgttgcccaggctgaagtgcagtggtctgatctcggctcactgccatctctgccccccatgttcaagccatttgcctgtctcagcctcctgagtagctgggactacaggcgcatgccgccatgcttggccatatatatatatatatatatatatatgtgtgtgtgtgtgtgtgtgtgtgtgtatatgtgtgtgtgtgtgtgtgtgtgtgtgtgtgtgtatatatattattaattttttttttttagaagagacagggtttcactatgttggccaggctggtcttgaactcctgacctcaaatgatctgcccacattggcctcccaaagtcctgggattataggcatgagccaccgtggccagcctctattttttttttttttaagaaagaagtaaaaagaattgaaaaaaaaagataacattaagaaaactagcaccttttggctgggtgtggtggctcacgcctgtaatcccaacactttgggaggccgaggtgggcggatcacaaggtcaggagatcgagaccatcctggccaacatggtgaaaccctgtctctactaaaaatacaaaaattagctgggcatgctggtgtgtgcctgtaatctcagctactcaggaggctgaggcaggaaaatcgcttgaacctgggaggcagaggttgcagtgagctgagatcacgccactgaactccagcctggtgacatagcaagactctatctcaaaaaaaaaaaaaagaagactagtaccttttaccatttcctgatcaaacaccaggctaggtacttggccaagcattttatagctattgtcgcttttattactttatttatttatttatttgagacagagtcttgctttgttgccctggctgaagtgcagtggtacaatctcagctcacgacaaccactccctcctgggttcaagtgatcttcctgtctcagccatccgactagctgggactacaggtgcacgccaccatgcctggctaatttttgtattttttttactagagacgggctttcaccatgttggccaggctggtctcaagctcctaacctgaagtgatccacccgcctcagcctcctaaagtgccgggtttacaggcgtgagctaccatgcctggccttatttattttttattatttatttatttatttattttgagatggagtcttgctctgttgcccaggctgagtgcagtggcacgatttcggctcactgcaacctccgcctcccgggttcaagggattctcctgcctcagcctcccaagtagctgggattacgggcatgtgacaccacgcctggctaatttttttgtatttagtagaggtggggtttcaccatgttagtcaggctgctttcgaactcctgacctcaagtgatccacccactttggcctcccaaagtgcagggattacaggtgtgagccaccacacccagcatttatttcttaaaattattttttaaaaagagagagagatgaggtcttgcaggctggtttgtgatcctcccatctcagcctcccaaagtgctgggattacaggcatgagataccatgcccagcccccagagaagaaacttttagacaggtccctgaagaagtgtgatggtgactagggtcacaccaaggcaatgagtggctggtgtcagaaacatttcctagcacagataattgaaagaggcagtcctttggccttggggtccttctgttcagggaggggcactgagcagagggtaacagtgactcaggagccagctgaaagcatgaaaaacaagttgctggccaggcgcggtggctcacgcctgtaatcccagcactttgggaggccaaggcaggtggatcacgaggtcaggagatggagaccatcctggctaacacggtgaaaccctgtctctactaaaaaaaaaatacacaaaaaattagccgggcatggtggcgggtgcctgtagtcccagctactcgggaggctgaggcaggagaatggcgtgaacccggaaggcagagcttgcagtgagccgagatggggccactgcactccagcctgggcgacacagcaagactccgtctaaaaaaaaaaaaaagaaacaagttgctgactgcccggttttgctgtgggctgcccaatgccttgtcctgtttataacggtaatttggggaagtgggggagtgtgtatgggcgactctctgagggttggagctgaaggcttgaagttaggtttcctaaacccacatcaacctaggaaacgtttgtgggaaggaatgttgcagatggttttctgtgtgtgtgtgtgcatgtgttcaagagaggccagcagcaacagagaggcagaacagtgagagagggacagcgagaatgagagggactgagcaaagaggagagagacaaagaaaggaaaggagaaagagaaacagaagtcaaaagatacacaaacagtagatgaggccaggagagaggacaagagaggaggacagagatacgcaagaaggcggggaagagagaaaaacagaaaagagagaattcatttgacaaatgcttgctgaacacctactaagtgccaggtgccattccaggcattgaggataaaacaaaggacaaaacagacaaaatctctgtccttgtgggtctttccagtgggagaatggagaacctcagagagatggtaaaaattcaaagaagcccacagaaagagactgagggacaagtgttcagaaagacccagagacagaaataagctaagacacagagacagaagaggctgagacatgtaaagacgcagagagacagaggcacagcagagagacgagaacgtgggagccccaggagcagaagcagagggccagcattctagagggggtgagagccacagcccaagggcgctgctggagaagctcttttcctgccagcctgctcagcgccacagcactagtgctcctgggtgaccggtgctctctcattccctcctcccagcgtcctcttcaagctcccaatctaaccactgccactccctgtactcactgccctggactctcttgcactgggctggaaggatcctgaggtgctcaacaagcatttgttgacttcaggaactacggcctcatcatatggatgggtaaactgaggcccaggctaacagttcaggatggcttcctgggcctcctgggttggaagcagtgccagataaaggacagagcattcaactgggagctaggacccttatggtgaggtggagggtgggtgctctcagaggtttctgccacctccacaactgtggagcctatgaatcatgtgagagtaagttttggaagagacctgtatttgaaagctgggactttgacgtttgccgatgtctgtttccgtggaaacaggaatcagaatcacagaacaagcctgcgagctctgctccgggtgccccagattgctagggtgagagggccgctgactggcacactccatgtgtcatccgcatgtctctggagtcctctcaacccccagcacgggctgacgggggaaggaagcagggctggagcccctgtaggaggggtggctagatgggaagttttgaacacagggctccacagagggaataaccaacctttactgagcactctttgggcatctagtgctgatctctgtatccccacccatgcggtgtcgggtacgcggatggaatggaatgagtggctcagatgaagaaaccttgccatttccagcacactcatcctcaggatgaaattactctgttatgctttgccacaaaacatggatccttcatttattcggcacacatgtaagccaagtaccgggcaacacagaggttaacaggaacctgttcttggcatccctcagcatccacaggtgtccaggctgggtcctgagttcacagatgctcatgaattcctacatgaagctgcaagagcttcctggtcaccttccagcctcatctatcaccacttcctcctgagccccatgtgcaccccctgaacccaccattgctctaatatgttggctgtctcatgcctctgtgcctttgtccatgctgttcccatggtctgggatccctttacctctgctggcctgcctagcaaactcctactcatcctttaaagccacagctccaagcctgtttcccctggacagcctcatctcctagactgtgagcgcctcgatggtgcaggctgagtccctccatgtctgtgtgcccagagaggtgaaggcacttttccaaccctactgaggccactctcctccctcttcttagggactccatgctagcttcaccctcaacctccatctagttcctccagccttgccctctgcatggactccctgcaatcagcatttgtgcaggttctagtgtctcccactttccagcaaaacacagcaacactcttacctgtgggtgctggctgtctcttaccccaagagttatccacacttgctgtctcctctctccctcccactcctccacggcattctctctcctctgcctcccttccactcctccactgccggggtctggctccagcctcatcactcccctaaaactgctctacgtggccgggcgtggtggctcacgcctgtaatcccagcactttgggaggctgaggtgggtggatcacctgaggtcaggagtttgagaccagcctgattaacatcatgaaaccccatctctactaaaaataacaaaaatcagctgggcgtggtggcaggtgcctgtagtcccagctacgcggggggctgagacaggagaactgcttgaacccggaaggcagaggttacagtgagccgagatcgcgccactgcactacagcttgggaaacagagggagactccgtcttaaaaaaaatagtaatactgctctacaccggccaactgtgcccttcacagagctctttccaaaagccgtgttcatgctctccgttgctcggccactctctcctggaagcgctgtcttcccggggctgcctcctcctctgcggctctgaacagtcctccttggtctccttcactggctcctcctgcatcagccctgctggtaaacctaggagcctgtccctagcttccccctgagagcactcatccattcccattacagccagaggaaggaaggtcacctcctccagctgccttccttgacaccctggggcagcctagcgcccctgcactgtgcccacgggggcctatgtgttccatcaccacccttgtcacgttggatcttgtaggtactaatggagtcatctgcttccccacaggtgacaaacctccaggaagcagggaccacagctctcttgttcacacatccatcccccacatccaggacaatccccaacaagcaacgggctgtgaagggagatagggtcagatcatgaaggaccttgaatctttttgctgcagaatttgggcttcattttggataaaatggcgattccccaaagggttttaagcaggagcgtgacatggtcagacctgtgccttaaacacatccctctggctggggaagggagggtgaaggggagtgttctgaaggcagggagaccagttaggggctgtgcaacaattcagggctggacccaaccatctctaccacacaccatggggccggtctctgcttctcctctttctcactcccagccagtgccaagcttggccagctggatctggtaaacacggcaccttctgtgtgctctcctcacctgatagaacggtgttggtgccgggtacagaaatggagattgactacaggaattggatggggagaaataatgaggccagctctggacacatggactttgaggcaccagagagacaggcagatggaaatgctctgtaactgaacacacatggctttggggctaagaaaaagggtctgcgccagtgggatggattcaggagtcattgtcattgaagttcagatgcaattagtgccatgtgaacttgcccaaagagagagagaaggtccaggacagagcctgagagaagcccatctgtcctagattttactactgttcagcaaacattcactcccccttcctgccccattgatgctgggcttggccatgtgacttgggagcggatgtgaggcttgcgtgagttggcctggcctctggagctccttttactctggaaagaacatgacagacatcctctgcccttcagcctgtgccccagaatgagagacccatgggacagactcaagctgtaccctgaagcagagctgcccagttgactgcagacctgtgagtgagaaataaatggcttttattataagccactgagatttgggggctgtgtgttaggtaacactgtatcagcaatagtttgactaataaaatttttagaggaggctggagaaaaaagaatccgttaaaggataacaggaagaatagcccgagaggaagagggaaaaccaggagagagtggagccctgaagctgtgtgaggagagggtttcaggagcatgggaacctctgatgctcagacaggggtgtgctgcgccattctgcaccatgtccgtaagtctttcccacatgtgatgcttgggtcatcacccatctctttttagttttttaaaaaattgcaggccaggcgcggtggctcacacctgtaatcccagcactttgggaggctgaggtgggtggatcacgaggtcaggagttttgagaccagcctggctaacatgttgaaactctgtctctactaaaaatacaaaaattagctgggcgtggtggcgtgcacctgtaatcccagctacccaggaggctgaggcaagagaatcactggaactcgtgagacagaggctgcagtgagctgagatcgcgccactgcactccaaacggagcgacacagcaagactctgtctcaaaaaaaaatattgcagtaaaatatatataacaaaatttaccattgtaactcttttatagcgtacacttcagtggcattgagtgtattcacattattgtgtaaccaatggaatcatcatccatttccagatctttttcatcttcccaaactgaagctctattatcattaaacgctaactccccactccctccttccccaggctctggcaaccacctttctactctgtctctctgaatttgactattctaggtacttcatatgaccggaatcgtagagtatttgtccttttgggtctggctgatttcatttagcataatgtcttcaacgttcatccatgctatagactgtatcagaactgcattcctttattatttatttaatttatttatttttaaatttttttgagacagagtttcgttctgtcgccctggctggagtgcagtggcatgatctcggctcactgcaatctccacctcctgggttcaagcgattcttctgcctcagcctcctgagtagctgggactacaggcacaggccaccacgcctggccgagggcagctgtcattctaaagaggttcctttgggaggggctctggtgatttgacctggaggaaatgaggtgggagtgaagcctttaccttggagaagagtgaccagcaagagcaaagttttggcaagtgaatgaaaatagagccatgctggtcccaggctgagagaactcagaggctagggcactctggtgagtctggtgaggtggagttgggggagtggtgggtgtcaggttcctctccccagctaccaggatagggccttgccttctgcttttttttttttttttttgagacggagtctcgctctgtcccccaggctggagtgcagtgacgccatctcggctcactgcaagctccgcctcctgtgttcatgcctttctcctgcctcagcctcctgagtagctgggactgcaggcgcccgccaccatgcccagctaattttttgtatttttagtagagacggggtttcactgtgttagccaggatggtctcgatttcctgacctcgcgatctgcctgcctcggcctccacaagtgccgggattacaggcgtgaaccaccgcgcccggcagccttctgctttcttgtacttcccagcgtccctggctcaagtgatcctcccgccgcggactcccaaagtgctgggattacaggcatgagccaccatggcctgtcagagtacttaaattctttttttttttttcaagacagagtattgttctgtcgctcatgatggagtgcagtggtgcgagctcggctcactgcaacccccgcctcctgggttcaagcgattctcctgccccagccacccgagtagctgagattacaggcacatgccaccatgcccggctaatttttctattcttagtagagacggggtttcaccatgttggccgggctggtctcgaactcttgacctcatgatctgcctgccttggcagcccaaagtgctgagattacaggtgtgagccaccgtgcctagctcaaatgcttaaattcttatgaaggaaataggtaggaaaaaaacaaaacaaaacaaggctgagcacatgggtgctttcaaattgaactaaccgattctatactaacccattccatacttgaagcctgttttgctatgacaaattggctcaggagaagtatgtgtccgttggaagacatttcaaaacacatttgattttaaatttaaatccacttctttcttagcacctctctgtttgctggccatgagtaatcatctttttcaattttcgaaacatttccccaattactgtctcccctgagcccccaaacacccatcccaagcggctactctccatcatcagaaccttgggctcagccaacactgactaatagcctagtaggcgattccccatcacttacctctctttgtcctcccagcctgcctttggcataggcattaacatactcattgcacagagaggacggtgaggctcagaggggaaggtcacttgcccaaagtctgccagcaaggcagtgaagccaggtctttgcgtgttggattttgtattccccctgtggaggcccccgatccctcagggaaacttctgctaaaaccagagctgaccggcccgaaggttttgatcagaggtatccccgtgcaattctaggactgagcgtgccgggtgcagaagtgggctgcatactcagcttccactgaaacagcccccagcgggagcttgcatccatcctcctagcagctgtgaggagcactgaaagagagctttgaaccagggaaagggaacaaggtcttctggcatccttggcaagcacagtctcctgggttgagttcatgggcctaaagtcccttttcctttaaccacctccttctggaggcctggaccccaaccatctggtgccagaacccaggattcctgctgccccagttgctggcagccaagagaggaaggagcggcccttctagcctaagcttggaattcacctctccgtcttcactcccacctcacttgcatgtcctgcaacatctggtcacccagttcatctgtccttctgttcctttcaccatgttactgggcactgagggtaccccagaaaatgatgatcattccctgaccctaaggagtcatattcccatggggaaaatgcacccctgaaccacacccatgcagtggggacacagagggcacacctgccccgaactgggagttcagaggggggatctgggaaggctctctgaaggagatgctgcctgcccaggctggatctgagaagtgttagtgggagtctgtcaccggagggggctttgggcaggggacttcactacagtgtaagttccacggggtaaggatttttgtctggtttatctcccaaggcctagaacagcgtatggtatatagcaggcgttcaataagcaggtcctaaaagaaagaaggaaaagaaaaaaaggaagggagggaggcaagagaaagatgggggacagagagacagagagaatatgagtcagggtggatgtgtgaaatggcatagccattctggaaactgaaagtacagagttccaggtgtctgtagtttaggagggtgtggctgagccgagggagtggccttatctaaccctattgttggtggtatccattccttatctccctactgggcccagtactttggggctggggtgagttttccctctctctctcggtccctgggggctcctggtgcctgcactgagtgttaacatacacaggtattgagcctgcgctgtgtgctggagatacacagataactcaaactgagatcctaccctcccagtctggtgggggagacagacagtaaacaagtggctacaacaatggggagaatgaatggtgccagcaaaacgagataagattggagggacagaaggacaggtttcactccaggagtgagaagcagggaggtttttgtggaggagatggcactggagggaggggatgttagccttaaaggatggtagaagaagggaactgaggcaggaagcattccaggaagacagacttcaggcccaaagatgtggcctggggggatccagaggggaaaggtagactggggccttgaatgctgttcatgggtgtttggacttgcttctgatctgaccacattttggataattgtgccagcagccacacacctacttagggctgctgagtggtcctgcttccagggaacccctcagcaatcttctagccagcaggggtgaggggtggctaagacactctccctgctctctctgcccgggccctctcaccatctcttttagctccaacaagggatctaccaaccatcgtgcagctttgttgtgtcaagttccagcaaagggctgaccacagagtgcctggcacaggatctctgaaccctacccctctcttcttgccacatgtttggaaaggaggtgctagtcctttttccagggtggtggtagggagagaaaaatataggagggaaattttaacattgtagcacatcagattatcaagagatactgtatatcttctaacctccctttgccatttgacaggtgaagaaactgatgctcaaatagatatgcttgtgttgcagccatgaagttgataagggcatggccaatctggttgagtcctgggtcatagcagggccggagaagggcagtgtcttcctttttttagccaggaccaaaccgatactcctaatttgtgggccttgcagacacaagatgagtcaggcttcttgtgagtcagtctgttgacaagccatccctggccattcctagcccattcaaaatagaaggaagtccagggcaagggtatgagcaggccaatttaattagtgtgggctctaaggtaccttaagttagccctattaaattaaaccgcctaggggaaaaaataactgtaattatttccttctctcccctatccttgtattccaactcccaacctccatgcttccctcattcacgaaacaacctttaaaatagggactagcgcacagacgcccataaactaggtctcagcgttccttttttctgcccctttcccctgtgagcgctgggtcctggaagggagcagagtgagtccagaggtgtccgcagggcctggctgtactctaatttagggaggttgttacattgagtagaacattattccaaaaatgcacccagagtctccttcctgaaccaatgcagattcttttgctgcggggcatttcttttaaaagccccttttctctcttctacagatcaaaataagcaaactttaatggtagggaattattgtttattttgttgaaatctagttctgagttttcctacttgaaacgtgttttccccaggacactgacctatcctttaattgtttggtgcgaggcatgttagggggaggggcgttacttgtttattggaacagcgcagttaaaaaaaaaaaaaaaaaaaaaaaaaaaatcaacctaggctaacagtttcaaggctcccctaaagatgtatccaaacaggcagccaatcagcgcttacacagctttttctgcttgactcttttaaagagacagtgccgacagtgttttatcacatttaaagagatccgctctctaaaaacagtctgaaaatgggggagccttcccctatttcgccggtatctggtcttaagagtccctaatgaggggcacgcagtgtgtcttctgggttctcggcgtgggcagaaaggagtcagcagcaaatagctgggtcactctgccagcccccccctcaatttcccattgtacacctgggtcactgacaatggaagcttcccctccccctacgcctgactctcgtcccctcactccccaatttagctccatttatttgaagtttgcagatttctgtggcgagcattccgcgtcgcgggccgcccaggtgacgccccccatctccgagtggcaccctttcccgtgcagaagccgaggggctaacttgccaagactggcaaaccttggaaatttgggagaaatcactctccctcctcttaattcaagtcccctgtccccagcccccctcccccccggctccccaaagcacgccaagggccattttcgcgcggctccactttggggttttccaaagtattttaatgatctagtaaaggagcagccgcgcgcctcggcgccggctcgagccgcccagctctcagcgtggagccccgggcccggcgctcggaagccagactgggcgagagggaggcccgggggcggggcgggctgggggccgggctggagtctggggagggggtcggggtcggagcctagggggaggacaaccaagagcggagggcgagataagggctgggctggtgcgggccgcggcgggggggagctgaggggcagataagggagagggacggggcgggagggagcgagcggcgaccgcttgggggtctgcgccccctcccatcggacgctgccgcagcgcccccctagccccccagtggtccacgccgcggggagcgcgggtcagatccccctcctcgctggggcgaggagaccagggtgcccccagcccgatccacgtcgcccaccgccccggcgacagaaagagaggctcgcgcccccggacgcccccagttcgcctgcaggagcaggcagcggctccgcggaggcggccgcagcggggactgccgcggccggcgctgtcagggcgtccctcccagccggcccgggcccgcccccgcgtgcgccgattggccgaggcggccatccatcgcgggacgttgccgcccgcctcgctccctcgcccgggtagccacgttcggttgagctccaagtagaccagcggcggcggcggcggcggcggcggcagcggtgctggaggcgcagagggcggcgcaggcggagccgggcgggcgcgcgagcgagcggagagcgggcggccgtgcgggcggcggcggcggcacccccaggccgagccggcgcggaaggagttccagggcgatggggccgcggccggggctgacgctttgacagctggaaagagcgcggagccagcgcctgggggggagggaggggagcgcggcgaggagagcgccagcgagcgagagagcgagcgagcgccggggagggggccgggagcgaggggcagctcgggagagccggagcggtagcggcggcggcggcggcggcggcgaggctcggcgccctcttccctgcaaaccatgtttgccaaaggcaaaggctcggcggtgccctcggatgggcaggctcgggaaaagtaagccctattttgcaagtggcggccgcgccgccgccgggctgcgggcgggcgggcggtgggaggcaggtgggcgggcgggcgggggccggaggctgctgcgccctcgggtccccgggtccaggcgccgcctgcctggccccttccccgaggccgcggcgggcggcgtgggagagcccattgttgggagccggcggaggttgggggatcggggaaggggcggtggggggagccgccggagggggtacttggtggccgtggcgcgggtcgagcgcgggggcccgcggtgagtggtgggcgaggtcccgccagcgagcctcgacgttctccccagccgggcgctccccgcggtggccgcactttgcccaccgggtgcgggcagggggcgcgtggcttctgcagccccgaagcctccttttgtccgcccgcggcgtgaggagtgcgtgccgggggctttgttcggccgggagcgctctcccttccctgtcctcggcttcgtcaccggctccgcgtcctcggacgccgggctgggcagcgacggtggtgccggcttggccccaggcttggggcacagttgtttggggggaggtgacgagggtggcgctttgctgccctctccagagcgcgccaagcacccggagtccagggccgagtctcctcggacctccaaagctggcgagagcgtagcgagcagtgggtcgggaaaggcaaggtggctgtggggtcgagtggcttgcgagtttgaggaacctaggtgggtttgcccgcgacgccacttggaagttcaagtttgggggctgctctccatccctcaccgcttgaggtaacgcgttccctggtccccaccccctaactgttcgcacctggcggccctgtttggggtgagctagctgcttacctctggtcggggccacaatgggacggcgcagacagggctcaaagcctgctggcaaggtcctggagagcgccggtgggatctgacgcctttccctctctctctttgccccctgtccactttccaggttagctttatacgtctacgaatatttactgcacgtaggagcacagaaatctgcacagaccttcttatcggaggtgagtgggactccccccagcatccaatttcttgacaccccccccccccactattcttagagcctttgttttcaggagcagccactgtggccaccattttgaatttttatcaccttttggcatttattgttagttggtcttcctagccttttggctctgggaagcccccagcccaccccgtctctgctcctctaagctgcttctgctcttacctttccagattcgatgggaaaaaaacatcacgttgggagaaccgcctgggtttttgcactcgtggtggtggtaagtttgtgtgatagttttgcatgtgtgtttgttttgttgtgagccctgggtccaagtgaacaaagaagggaggcttggagcaggccctccgccctgtggccctctgcgttgcacagagcggggcacctcgaggcactccggcccagctggccaaggaggagaagggcggaagaggatgttacctaaagttttggggggaaaaacgacaaaaccatctgtggtgttggggtagaaactccttacttttacatttcactctggggctctaggcagggggtttgaaaaaacattggaggatttttgtcaattctgcatgttgctttaattagaggagtgggggtggggcggcgtggaggggataccaggtctgttttacaactagcctgtcccttcctttttctcctcgggagctcacaaccttaagagaggacatctaccggggctttttccaggcaccctgagaaagagcaagaaagggctgccacttcctttaaagatactgattcagactgactggtccttcctttcctctgggagctccccgcccccctcccccactaaaaccacaaagtgttgttttacgcagaaccttaactggtcagagtcgacctcgcagtgtctgcagttaggggctcccactctctgtgactctctaaccaggcctctgtgtcctttgggtgtggggccaccgcaggtctggtctctgtgttgggtatatgacagccaggagggagctcagggtcagccggagccagttgccctaggtatatgacccgggtgttttgtgggactgactggtggagtctttgacatccttttgaaaaagaaaagaaagcagagtggcttttgatattttgatggagttcagcaaaacggtgtgtcctgtctcctgtcgttgggatcttagcgggtttatctgccagctcaggttactgttttaagtctcttagaacagcaggaggatgaagtgtctgttctaacttgtgcagagaaaatgagtttttaattacttctgccaacctcggaactgccggtcttggaggcatttgtgtggcggaaggattccacctgtaggagtgggtgataggctttctgtggctgtttttggagggagtgtgtggatggggttggcggctctgatcggcttggatcttgtagaaacttaggtttatgattgaaggttacttaggcttatgagtgaaggggccggggaatttgtagtgttagaaacctttaacgtgtggaggaggtaagcagatgtgtacagttccagaagacagaaaggaatgttctccagcccccctctgcagctagtagaagtcctgattttcctgttatatccagaatctcctgaaacttctccatccttatctcagccgcaggaacgtagagtctgttgtgttaggcccgggcggtggtggctttgagtggctgtggccctgtttggtagaagttggtttgtgcgatttgacactgagcaaatgacccaggctttctccagcgggaggaagcagtggagcttgtctggtgaggggcaggctgcattattcacaccttgagtgagatgcttgtctgatgacttgcagagctggctgtttgtgacgaggacaagagcagtggaccaggagtaggactttggttttggtgcccactttaccctttaagcttgttctgtccctgggcctcgggctcctgatttggagagtttcttaggtcccttgttaatatcactgacaactccgtgtttgaatagggctttattggttgacataggacttgtatgtctgttctcattttaatacagaatgtcggagtgaccatacaaaatctttagtggggggtgaggcaggcatttctaggcctgcttccttctttccctttgctgacaggtgcttctgtgaagagggccctctactgcaatgtgaaaggactggatacttggttgtccatgacctgtcctttgcctaactgatttgtgttttttggtgcatggagggaggagtggttcttgcataagaattccttgagggagggcttgggtgggagtgggggtgaggtgggaagggtggaggtgcgggctctgggattaagagcctgtaaagttcctattgccagagtcttccaaatcgcggcatatatgaatcatagttgtgttctgactttggcacttgaaccttttttaggatatgcagccattttggtttgggtggtaaaaaggaaacagattagaacagtatggattctcgtccacatttgcgttcatcctcctagggcatccatgagtaggttctactaaccccttggagcttcagttgccccctgtgtaaagtggagagaaaattgcctaccttacagtatatggtagacacaagtaatacgggtgtgaagcatccggcatgtagtaggtatttgatatataagaactattactgccattactaatggctggcttgccagaagaagttggacgtgttttgttttctaggctgtttgcccaatgagagctgataaggtgggattgagcctttgggagacctagtactgttagcgccatgcatcgtgcacttgcccttgtgtacacaagtaataattagtaacctgaccttattttattttcctcctcgcagtgtattttgggacctttactgtgcagctcctgaaaggagagacacttgtgaacattcaagtgaagcaaaagcctttcatgattatgtgagtaacatatttttaatcctagcaataattatagggttggatagctctaacttctctagtacgaaaagcaaacacagccagttcgcagtggtctttatttgcttcttgcgtttctttctgttcccctgcccacctctctgcagccctcccaatggtacctttctccagcagtgttctaacttggtgaacggtgtttcataatgttgtaattgtgcaaaattgtgtagatatctatccggagaattaaatggtgttgtacaggactcagaactgtgagacttatgttaagagtggacagttagctgagaggggactaagcctctttagtgttggtttaagaagaaattgtaacaaacaaaagccaataggaaacttgcgttttggagttgagtgagaatttggtggaatggactctcttgctctactttccagagagcgatctttcaaattatgggtgtgtgtgtgtgtgtgtgtgtgtgtttggtgtgggtgggctcatactgtatctgctaagacgatttgtactctgagatcctcagctagttcataatcttgtggccaaaatattcttgtgaagctagttaacatcagattgtagttctttctaccctgttactcactttctacctggatgagtttcttaagatttatgaaattattacgagagggttgtctgccatctattcatctcccatagcagtccccttcaggaaaaacaaacatgggtttcaaacctgggttgcagtcacacttgatgatctgatgaaatgggttaggatctgtcttggggagatggaagaggacgtgtctgaaggtcttccatagcctctgttcagttcttcttgctagccctgtagacagttaagcatgtccatatagcaggtgatctaatggtcttgctcttctgtgtgcagtgggtaggaatgatcctgggaaaccatgggtccttgggagttggtttcttgaacgtcattgggtcccacctgcttggcccagccatctgagttccctgcatgtggaggtggaaattggctaagagaccagacccatctggttatttcacaagtggtcaaatcccatgatcaccaatgtcttcatggtgaaaatttctcctgtaatgtgaggagttagagactcaggtggtggcctactggttttgagaatattcaatgtgatgcagttttgttgtgaatgaaaagttaatgctcttggaatgtaacgctgaggaaattgagcagttcttgttccctcttcagggctgaaaaagagaagctgatgaatggtacttctggtctggtaaacttgcatggtagtgaaagggagaggtcaccaccggttcacttatgatgtggttcttctgggaaaatcccatggtgatgataaggtttcctgacctggatgttcagggaggctaagaggtacacagccatataaaaatagttgatgaatttgacctttctacctagtaaaaatcttgcatggtttttttcctaaacctgtgaacagccaacactgttgctagtttttgactgctatgtaaatagtttcattttagaatctggggatgggtgggtgggtctttcactctcttgatgtagcatatctatgctattttttgcctgtacctttcagagaagttaatgattttaaccaagttcggtgctctacaaatttgagagtctttggcaacttgtggtgtcgtcttccatcctgaaacaatatggcggccatgaaagtttgcacatgggtttgctttcagtaatttgctgaggaatggcagtagaaatgtatagagatcactgaggttggcgttgacatttagaagatgctactaagagatgaggtcaccctaattgaggcctacacttcatatgtgtggggtgtaaaaacctttttttttgaattgggctccacctggtatcatgtggcctgagagtcagagcctgtgggaggagggatggagtgatgaatggggattatgaaggcgttaaggggtagcattgagttggaggggtgacagcagagaagcaagtggaaaactaagaagaacttcagaaaattaggaaaaggagcccacttttctttttgtctttctccagtcttcatctagtctctcccttcttgtggctacagtctagttaaccttcattccttcttgctagaatgattgcagtagcttcttgctgactccttcctcttgcctggaatgcattcctctcttacccattcaaatcctattcatcttttaagacctccttcttggaggacttatgagatagttttctgcattctgtgatcacgccttcatctccatatctataaaaaccacctatacaaagcctctgttggcagctttccgtgtgccaggccactctgctaactgctgtaggttcagtccctcatatcctgccagagacccgatgagagaaggcttgttgttcactccattttgcagatgaagcagctgaggcacacagtggttaattcccagctgggaagtggtagttagaatgcacacacatggagtcatgactgactctggaatgggtgtttctaacaccacctggcttggccctgcaggcccatggcaagtaccatttgttggcactattccacctaacttctcacttagggttgtctttcgggcgacagcctattaattttttccatggtggagaccgtgaactattcatctctgtagctcccacagtaccttccatgtagcaggcacacgtgctgattgtatgaaggagttaggtaagaatgagtaagtcacttgcgggtgagtgagtcttgaatggtgttcttttagagacataattgttgcgggtgctctcgaacaaggtgattttgaagtcaattaactagttgccttaactactttttagaaaatcaagtagagtgtaaataagtgtctgttgactgaccttctgttttctatcaaggagatccaaagattctcagggtgtggggagtttgtgcagcctggataccagacccatcttcggtgggtaggaagtgcttacaggggcaacgggagcattgggggaactcacatctggagtggacttttctgataaattggtttgcattaaatcagaagaggtcccccgggtcatgggaggagggtcacgggaggagggtcacggtcccattgtaatttccttgctgttaccctcaggccagagcagtgcatctcagagtgttgacaaaagcccatgggatcccattggggcatctctttgggttctcttagacactgttgtctgggtcctgaccttttgtagagtggacactttcagctgcatgagtgtctctaactgtgtgcccagaggtgtcctggccaccttctccgctttgactttctccagggtggacctgcagggaagtgtctttggtgccttctcaaacaacaagcaatcctttttctccatgtggtagctaattttgtgttttccttttgatgtcaagaaatgagtggaatttggaaggccaagaaatgagtggcctttgagccaaagagactagagaatagcaatggattcttacactacacatacctgctgtacttttttataacatgttttcatgtgtgtgattgtggctgggctttgcagctgcctcgtcggttgggttttgttacaaaatctcactcccattttacagatgaggaaactgaaccctagagtttaggtggcttgtccaagggcaggcagccaggtgttggcagagctgagactagaaatcctctatctttctagttctgcctctcagcttttattgacacttacttgataaagaatccctgcaaaacagaggggaggtatttgcagttgacctgaagcatacctggcaccgggtatgctggttggtgccccccgacatgttcactgaagaaatgaacttaacagaattgaacggaagcccccgcaaggtgaattgtggagtcactggcagaggcgagacctgaactctgggaagggggtttgttgtggtgcaacggctcttaacttttggcagggaaaatgtgataaaagctatggacagtatttccagaaagccctcataaaggggactttgtgcatggtttcaggaggctcatggacagctgctccaaccccaggcctctctgattcccagtgaagaacttggggagtgaaatggacatggagttccatgaccttgatgaattttccttgcttgcctcagtttcctttctctgaagacctgagttccctttcatcttggctgttgtgtgctccacctcagtgaggctggctccctggccctgtcctcccactccagcaagactctgctctcccaccccaacaagactgctgactcctccctcagcagaggggagactttgccttgaggagggttggttaaagtaggaaagtgccccagagtcatgggcgtgggcaggcactgaggtatttgtggctgtgtggcaggggtccagcgtccttggtgggtttgaaatagcaaagtgatatttgagagggctctccttggatgtgctgagctgaggttcctgccaggcagggagtgtccatgcctgccagaaccctttcgggggagggggacaagagggtggcagtgcaggctggaataggtggagaaggcctgcagctgggctgcaaagagctgggggagtgtgctgccctgtgataagccaggctagctatctgcccagaggtcctggcaagttcacggcgttgcctttggctctgacccttggcacccttgtgtggcagattaaaaacacaaaacatacacacttctttttcccctctcccccattccccttggagcataggctttgggttgcagcccctctttaagctcccgccctgttttctgcaattcctcttaaccccagaggctgccagactcctccatcggtagctaattaaacattaaatgagaaactggagttgcattttgccagcacccgagcagtgcagccaccttaatgggtttcaagtggcggcaagaccccaaattgcaaatccttgccctttatttcaaggcgggaggtggggcggggggagtggtggggacccaaacaaaatttttggcagtggtcacttcatttgaactcccagagcagcagtgtgcaccagtctttcgcataatgccatctttgttagctaagcatttgcaaacttggaccaagagttagctctgtgccagccagcactcagagggagctgggagatacccagctctccccacagttccttaggtcgtctctattttgtgagggaggcagggtctcgagtggggaaccctagtcaagggtgcctggcccccttcccatgacttccctgcctctgtatgtgagtgtgtgtgtgtttaagccttaacagggagaagtggcagggaggtgtgtgtacttggggatctgtcagccaagataacagaaatgtggcactagctgtagcctttataatagtgtctgagggtttagagtatttagaaaaattaatcttttttagcttggtaataattctgaccacggcacaagtgcattagactattcacataaacttctttaatacatgttgctgggagctcttagagcaaatagacaatcatgactgtttgtttttgattcgctggggtaatggggttgttttttttttttttttttttttttttctgagatggagtctcactctgtcacccaggctggagtgccatggcgcgatcttggctcactgcagcctccgcctcccgggttcaagtgattctcctgcctcagcctcctgagtagctgggattacaggcgcgtgccaccacacccagctaattttttgtatttttagtagagacagggtttcgccatcttggccaggctggtctcgaactcctgacattgtgatctgactgcctcagcctcccaaagtgctgggattgcaggcgtgagccaccgcgcctggccggtaacggggttttttgtagccttggcaaggtgagttttagcagtgtttgtgtctgtgttgtgtatttctttccctgggttttgaatcctctggattttaaaggatttgggttgtgactggtggcttggactcccatgtgaattctagtctccactttgtcatttcttggctggaaatcgtcagggatcctcatttcctggccgggagcctcagttttcccatctgtagaatgggggaatgctgattcctttgcatagtggttgtgagggttaagtaatatagtacagtcatccgtcaatatccagggaggattgattctaaacccccccaccgcccgtccctgctgtcatgtctcacccctgcaccccctcaaggggcagagctggcagtcctgtcacagactggtactgataaatggcgtctctgagatgtctgtgcaccttatctgtattgggcagaatggtcctgtcccactcctgcatatggccactgcatggctaaatggtaaggcccagagggcatgcagcttggcatcagtaggaatctagatttgcatttcagcttcatgtccttgttagctgtggggggccttcatttctcaaggtccatctctttactgtaaaataggctcaagggttgtcctggcacagcccaccatggggacggccttgagagaggcatggaaagctgtccagggaaagttggttgtgctgtgaaatcctgtgtcattgttaacagggatgaaatgaggagtcttgcactgttctctttggtatgtatcctgccctggcaggtgctcagactgtgcctgatttttttttattgtataagggaatccccttttattgtatgtggaaatcccacaaaggcgattcccacatacaataaaaaaaaaaaaaggagtcttagccgggcgcggtggctcacgcctgtaatcccagcactttgggaggccgaggctggcggatcacgagttcaggagatcgagaccatcctggctaacatggtgaaaccccatctctattaaaaatacaaaaaaaatagctgggcatagtggcaggcgcctgtagtcccagctacttgggaggctgaggcaggagaatggtgtgaacccaggaggcggaggttgcagtgagccgagatggcgccattgcactccagcatgggggacagagccagactccgtctcaaaaaaaaaaaaaaaaaaaaaaaaaggagtcttaaggagacagtgagcttgagaagggaagtgtcagccatggcaggtccatgggaagctggttctggccacattggcttctttttcttttgacttcctggggtgaccctgaggccttgatcagtcggcccccagaccaggagaataagacactaccgtattttgaggttaccaagctcctactatgcttactgtctagttgaagagacagatgcagtccaggatgagatgtgggcttaaaaagaattgtgtggaatgatcttgtttttctaagagaccaagatacagtcagtatggagttgggggggcagtggggggaggtaaacagtcccacccctgtgttgtaacgaaatatatatttatcatagatataaatagcaggattgcaggtgatggaactggaggtcacctagtgttctttcaagtagctaaagaaacatgcgcagagggaaaggtgccctgcgtgaagtttccagtagaactcaaacctgcctgcaagcctaatcaatagtccaggatgctttctttcctttgccttgttgcagttacgagctgtgcaaacatggacaccttaagtaacctctgagcctcaacttcctcgggtggaaaatggggttaataaagtataccaggccgggcgcagtggctaactcctgtaatcccaacactttgggaggccgaggcaggcgaatcacttgaggtcaggaattagaaaccagcctggccaacatgatgaaactctgtctttactaagaatagaaaaattagccagacgtggtggtgggcgcctgtagtcccagctactctggaggctgaggcaggagaatagtttgaacccgggaggtggaggttgcagtgagccaaggttgcatcactgcactccagcctaggcaatagagcgagactcagtctcaaaaaaataaaaaaataaagtatgcctttataaggtcataaagattaagtttacacatatacacacaatatataatagtgcctagcacagtgcaagttctgcataaatgtgtgctgtcatttttcttttttaattttatttttaatgttttgtagagacgtggtcttgctttgttgcctaggctggtcttgaatttctggcttcaaaggattctactgtcagggcctctcaaagtgctgggattataggtgtgagccactacacccggcctgtgctgtcatttttcttacctcacctccggcctggtctgagttctggcttcctgatgggcagtgttctcagtgattgataataaggggccagcagaatgacgttggggtgagaggtgtgtgcctgtgaagcgtgaaccatcatgggctagcttccctgttgatcagctctctggatccctgggtttcaggtacccctgggggattgtgggggcaagtcacattatgttctccctgccccagtgattggaggagcaagtcacatatgccgcttccaaaccagccctggtgcttgtgaggatgagaaaacagtggacgcacagatgcttctggcctgtgcctggcctgaagttgccccatcactgtccattttcttctctcctagtgacttctcattttctaggaatctggaacaggtgctttctccagccactttggcctcttcaccatgattcccgcttggtaccataccacctgagagggttttttcctcccctgccaattattcttctgtagagccaatgctagcctggaatgtggctgcctccaccaggcctgccaggacgactcctatgggaagacatccctcttctgttttttccccaggaactaactctgtaactctcctagtcgtttgttaccagctgcctggaaggagagttatttcagttaaggttgtgtctcttccttcccctttctggaatgaaagctccttgaggggaggaactttacttgccctttctgccaccccattcctggggcctattgcaggtcttgaatgcattctggggtctgtgagcaaggctctgagccttgagaagtgagaaggatttgattcctgcccaggcatcaactgtgctaagtactcgttttaatgaagatggacaaggggcacgtggtgaagcactgtttgtaaactgtgagctgtgacccattaatacatcatgaaaccaacttagtgggtcatgactggtaattaccaaaaaagaaacaaccgtattacacagagtaaacacaaatattgtttctggaaatgtctgttttcagtgatttatgtgtgcatataaaagtatgtgtgccctgggtttgtgttgtagtatttgccttttttgggggctcaacgcaaagtcagaaggccactagcccagagacagctgagactgaatcttagttcctacaagttaagtgacttgggtcaagagacaagcaattgctgagcctcagtttccagatctgtactagaaggaaatgatccataccttagagagttctcgggaaattgtttccccaccacatgttgtgctttcagagtggtgcctggcgggcacttggtaccgttgtctctgtggtttgctgccatagtcttagtgcattgaacacacagaaaatcccaacagatgcttgttgaaggcagagtaagtaacagctcccattggagggggtgggactgtggcctggaccactctggagtgggcgcgggaggagagggcctgagagcgcagggacactcttcttaatagcggagtccatgtggctctctaggcaaagctggaggagtttgcagcctgtccctgctggctggctgtggggcagctccttctgcctgtctgtgattgaggtgggtgggtggagggggttccttgccccccgtggagcttgcgtctgaacagggcttaggcagtggcagtagtgagaataggtcgtaaggcatcctgtctgaccgaggttgacccagcctcccaaattccctgtcccctcctggtgacagctgtttgcacagcttccagggcaggttttgtgtcccctgctctttgtgtgtttgggtgaagcgcctgacatttcacttctgtttcacagtcctctgaccttaagaagcacaactgctccctggggccgctgcctgaggttttcctctgatccttctttcccagtcacaaaaggctgtttgagagaggaggcagtggagaggggggagcaggcctctcccacattctgggatactgctgcagcgctttgagctctgagaggggcagagcgtagctttatagaccggatggaaatggcagatggttggtgggcagttattgcccgctgcctgccgggctttgccattagatgcagtgttgtgggctgtacatgggatttggacttggatgaccaaggtacaagatctgattctttcagatggccttgggtaagttgtctggtgtctgcaaaatgataggaaacagtggccggcttttttctgcccctccagctttttggaagttgggtgagagcacgtgaaaatgctttgtgagttgtggtcccctttgagaaggctgtttcagatgtgcaagaagaaggagacactcagtttccagatggggacactgaggctggtgacacagcaagcctggggccaccactgacttgagaaaacctccacctaagaggctggcgcccgtgtctgtgtctgtgccatcctttaggaattttgcagctttctttgggagaggctgagagcttcctgtggcctttggccatccagccggtgctgagggggcagatggcccagtgggcaggcctggtgccgggcgtgtgcgcactgccggtctctgctcgccggcttttagacggcttccagtagaaaatgttctcctctctctggaggctcttcctcttggcagcgctgcccgcctgccggccagatcccactcggagcccgcttgtgttacgggcggcggccctggcccgcagctccgggcagggctctccacgatctccgcgctggtgagccgcttcaaaaggggattttacagcatgacagggaatttcagccaccacgttatctccgaattggccaattgatggtttcagcagagcatttcagcatcggggaagccaatacaatttgagttagttgtgatggctgccactttaaataccgcagtgaatttctgtcagcgagctaatgcgtggaatagggaattgcagaaaacttgatcatcagagtgcttcagtcgattctgaccccaagctacagaaaatgaacttaaatctagttgactgtcgccacatactttctttggtgttattttgctggcagcgtcttcttcagagagagctggaagagaagagactaggaggaaatcaggatgtttgccgcgggtccctgggattttagagagtgacagtcttcatgggaggttgaccattgggagttggggtggtgagttcttggtgagggataaatttctaaacgacagcattatggcttagtaataatgagttttctatttaacaaagcaaaccagtgcttattgagcacttactatgtgttcagacccttaaaaggcattcttaggtatctccctgttggacaatgtaggggacaggcattcctcccatttcgtgacggaagaactgataacaatagcaaacaattattgagtgctaaccgtatgccaggcactgttgtaagtgctttaggttttgtctattgtcatactcaaaacagccctgtgagttaagttctgttattcctattttgtagagaaggaaatgaggcacttagagggattcagtcatgggcaaggtagacttaataggtttgtcttcttaatttaaaaaaaaaaaatttttttttttgagacagggtcttgctgtgttgcccaggctggagtgcagtagcatgatctcggctcactgcagcctcagcttccccaggctcaggtgattctcctggctcagccttcccaagtaactgggactacaggcatgtgccaccatgcccagctaacttttctgtttttttatttttttatttttttttggtagagacagggtttgccatgttgcccaggctggtctcaaactcctggcctcaagcagtctcctgcctcggcctcccaaagtgctgggattacaggtgtaagccactgtgcctggcccagatttggcatcttttctgtctcattaattgatgaccccctgcccagcctggagtggtttgatgctgaggctggcaggaccaggtgggtcctgacggagatgagccagctgaagcctggcctgggctcatagggttcctgactggtgcggtgcttctctgtgggtagagggattgggctggtttttaatgacctcgtccaggaagaaaacatcttggctttgggacctatgtgacttaaagaaaaggtttgctatctcttcactcaaaaggctcccttttattaaatctcctaccaccccctgtggactccaggcttgaaaatattttatttacaaagagattgcatgcattgagtcaccattaattttaatgaagaaatgtggaaaatgagaactatatagctgctgatgagactttctcatcagctcaggggaaccaacgtgagcacaccaggttggtagaacagaattctagtcaacagaaaaacattggaaatttcagttccatttcaattgaggcagacccgattcttctagaacttaaacaatattagcaatgcctcaagagcccccagtgaagttttccagaaacctggttagaatccttaggcaggacccacctagcagtggtgccttctcactttgtcctggcatggccagggttgacctctgtagagggacatccctcgtgtttcccccaggactgaggaaggttagaatgcagagttctctccggagatggctgagctctctttaggcccatccacccctgctctcctggctgtgcatgcaaggcttctctgttagggcagtgcagcttggagggtagacacactgagggtgtaagagcctgtgtgaacagctcccatctgcagagcctcctctccttacagatatatcccaaggcaggggtcccatattccctgcggttctgagctggcattacctgcagcagatggatcactggacagcgagtccggaaatcatccttctccaccaagctttcccacttaatagcttggtaacctttgacagatgatttctttctttcctaatttgtagcatggggacagtgagggatacaacagcagtttctgaaacagcagtgaccaccatttactgcatttaccccaggccaggcactgtgtgtgggcatggcatttaatcccggtaacactctataagataggggctgttatgacctcatttctccgatgaggaagccagggctcagagaagtgaaggcatgagcccgttgttatgaagtcattagatagtagagctgggatttgaacccagagccccactctacctttgagccatgctgctactttgacaaacttttggatgactttgggagatggggaccttggggaaaaatgcactttgaaagaattggatcatttcagtagaaacctgtaaacgtgtgtcttaaaaaaaaatgtcagtgacagtttgcttctcggtgagatgaatgcagataaacctattttgactgttaacttattttgttgcttaaaagccagtgacatgtagtgttgaatttatttttcttcacaacatttaagtgtttgccacttcttgagtgacgtgtgtgaatttgggaattgcctgtactttgggaatggaggccgttgcttgtatgtaaggcttttgccttaagagggacttttgggaaggcttgttctggctcggggccttgctaagaagcgactcgagtgcagcaagggtacctgtgtctgaggatattgatagagctgaagctcactctgaagttggggtcatggtggagagccgatcgcaggagtctttgtgactggaagcctaaatatttattctgttctgtccctaatgaaaacaaattgtcaacagttgttcggtaactgactaaattaaaatctgtaattagtcaattagattaaagagttggcacaacctgattgtatcatgctggttaggttattaagagaaagggtgtgatttttaattactgaatgctaattttgacagtttcaaatagaaacagacgtgtttttcccctctttccctaattctgaatggtttggaaagtaaagacactcaatgtgtaaatgatgtttttttgaagaaaaataatccgagaaggcccttctgtagagtaggagggatttcagcaaagagcccacgttggatttagttgaaagggttagttggaaatccttcctttcttgaagaggcatggcttggtttttggcagcttcgtttttgctgtcaaggagaggttggatttcagctttaagcagtcgaatcattgagttctttttaagggtctccccgattctctcaacttcaggcttttttctggccagtgccctggaaactataagcaatagtaaacgatccagggaggaatcccctgcgaaggaagcccagtgggcgctttgggacactagcacgtgtgagtaatcatacccagtgttgtatgaagtgtcttctcatacactggcatcccaggaagacagacggatggaacggatgttcttacttcatggaataaaagttttgctgactgcctgaggaaagctgagagcagggaatgaggtgccccggtgtggagggtcagggggagaatgtactcggggtgggtgctgacaggcaagaaggaggggactcctgttgagtagtaagtagctggggatgacaggagagaggcctcttgcttgggaggaagatgggatcggaaagtagagccagttcaactgggtgaggtggtgtgcgcctatagtccagctactcaggaggtagaggcaggaggattgcttgagcccaggagttggaggctgcagtgagctatgatcatgcctgtgacaacatagtgaaactccatctcttaaaaaaaaaaaaaaaaaaaaagtaggatcagtttatacattgtggattgaagctagccagagaatttagcacaattagggtagatgggtttgaagatggggcaaatccttcttcccactttgtttttctggcggatgctgtgtcgttgcttcccctgctgacactggaatacgggatatgagcaaccttggaactgggggtgagaacacctgagctgcttccagccaagggccccagtacagtgtggatcccctcattggccagagggaccatcccatctccccatcctccccagctcctgggagttgatgatgtggaccgctccataaggtgctgtgcccgtggggcattttatctgaaggataaaatgtatctgaaggatgtcaatcctaagaataggctcatgggccactgcaggaaggccacccagcccttgcttttccttgcacaaaggaaacccctccttctgtggggagcgaggggttgaagctgtaaccctaggcccctgactgcccactggacagcagcatccctgtcttgagggagagccaccctaaacatctgtgcctctagaactgcactgaaccccacactgcatgttaacacagtctctactttctggatggttttcttgtgggctgagtcttccatgatactttttgaagcatcagttaaaatggcctttagctttcaacatgcaatatttaaagctgtgggtgatccagaatgggtcatttttctttgaaaaaggaagcgactttactttttgtgtctgatgaatatggggtactggggaaccaaggtgcagagaacgagagcttttgaaggttaagcagcctgggttctaatccccacaagagcgcccccatccacagtgtaacctgtgccagttgattaacctctgagcctcagtgtccttatctgtaaaatggggattgtactcagcctgcagtactgctttgagataatgaagcagagcatgttagaagatatttcaggaatgaaagaatgagaggctgaaaggaaggtatctgtgcttagggagtgattctggggcacgtttagaagcacgaataagtaagaggagtggaatgaaaagcaggaagtatttatgaatggtggactggggtatgttctgaatttggaattcctccttcagactcaggatccatagccaaggttaaagaaacccataagaggttgtgtgtgtgtgtgtttggggttgggggcagtggtagatagaagggaagggacagtgctaggagagagaacattttaaaagcttccccactgatagatttgtagccctgggtaaatagggaagcttgtaaaacttgattcattttcttcctgaagtctgtttttggtggggagcaggggtgaggacaaagacagctaagggagccaaatgcttttaggttaggagtgtttatatgtccccagcacaagccatgtccttgagaagggccagggatgtgtttcatcctgctccctgtccccaaacgatctttctcttcctaagtgccagcttccctagtccatctggggagggactgcccactgcctgccatcaggggctgtgctcaggcctcatctagggatctgcgctcaggatgacttcctacttccttcctggcctgcggtttgctcttttcttttggttaggaagtatgtccttccctgtccctgcccaggcctactctggagacgtggacaggcagctggggccaccattagccagagaggagacagggtgtgtcgacaactggaggcccatgtgagctgttcaggaattagaagctactgctcttggaaaactgctgcagaaatggaaaggtggtcaatggggagaggtgagaaggtgatgggccttgtatgttggaaaaaaaaaatttagagggacttaacggaatatttctgtgttttgaaataaaaattatttggggacctaacattaaaaagacatctgtgtatttttctgttagggtggaatgtgaagcctgagattcctgggctgtagttagagaagggccagctctctgccttggggcctttgcacaggctgttctcccagcttggagcacttgctgccattctttctcctctcagggaaccctgtttatttttcatgtctcagtttagacatcacataattctaagatgcttctaataatctttgagcctctgggggcagagcccatggtgggtcttgtaaactgaggccctgacgcttggtggatccccactcaacatttgttggctgaaagagtgatcagggaggatcaggaggctgcccacctcccagggcccctctgtgcagtctgtgcatttgaatggttccctgaagtcttaacgcccttagaacaagtccaagttcgtctgctcagttcgagccctggccttggtgtttgcctttcttttctgaagtaggtctttgacacatcgatggagcttcagatgtgaagtgtcctcagaggtgtgtgggaaaatgctctctgttcagttaacccagccttttgacaacttctgaggcctctcgggctagaagccccgtgactgttctcctgcccagttcttgcttttttttttttttttttttgagatggagtcttgcactgttgcccaggctggagtgcagtggcacgatctctgctcactgcaagctccgcctcctgggttcatgccattctcctgcctcagcctcccaagtagctgggactacaggcgcctgccaccatgcccggctaattttttgtacttttagtagagatggggttttgctgtgttagctgggatggtctcgatctcctgacctcgtgatccgcccgcctcggcctcccaaagtgctgggattacaggcgtgagccaccgtgcccggccggttcttgctttttataaagggggctggggagtgggtggacagggatgtgatcctggaatccagaactccatcactcagcctgtgtcttagtggggtgttaatggaggatgatggaaaatagcccacttctgatttctctctctccctcatagctctgtagaaatattttattattgaacaccctgtaattcagggttggtggcgattttatcaggtcatacaagtctacagttgacctttgcattatctaagaagacttgtgtttgcttagccaaggataaacaagattccagtgtgggtggcttagggcttggagctgtggtctctgtgtgcagggttgcttctaattgtgaatggctcttatctgttcttcagggagggtctagccacactgtagtacagggacttctttatttcttttttctttctttttttttttccttttagagacggagtctcgctctgtcacccaggctggagtgcagtggtgcgatcttggctcactacaacctccgcctgccgggttcaagaaattctcctgcctcagcctcccgagtagctgggactacaggctcacgccaccacgcccggctaattttttttttgtattctaatagagatggggttttactgtgttgcccaggccggtctcaaactcctgagctcagacaatccgcccacctcggcctcccaaagtgctgggattacaggcatgagccactgtgcccagctggggcttctttcttttctttcttttctttctttccttccttccttctctttctttctttcttttctttctttctttctctctctctcttcttttttttttttttttgtcatggagtttcgctcttgttgcccaggctggagtgcaatggcacgatctcggctcaccgcagcctccgcctcctgggttcaagtgattctcctgccttagcctcctgggtagctgggattgcaggcaggcgccaccatgcccagctaattttgtatttttagtagataaggggtttctccaagttggtcaggctggtctcgaactcccgacttcaggtgatccacctgcctcagtctcctaaagtgctgggattataggcatgagccactgtgcctggctgggacttctttatttctaagcctgccatccaggcttttccaagggcctgaaatgcttactgcctttaaacaactactttctgctaaaattgtcctaatagtatcagtttaggaagatattttatccaaaaatccacccataggtcatcaaagatatttgtctttatcagatattcatctaatctgtctagtcttccattcatcaaatatttgatgcctctgccgtttggctacggaagcaaagacaccagcaaatcttttgccctcacagacctcatagactattttcctcccctttatctggggttatgtgttttcaaaatgctaactggctgggtgcagtgggtaacatctgtaattctagcactttgggaggccaaggtgggaggatcgcttgagcctaggagttcaagaccagcctgggcaacatagtgagaccctgtctgtaaaaaataagaaataaaaataaaatgcttactgcacatctgtattttttacttatttattttttgagacagagtctcgctctattgcccaggctggagtgcagtggcacagtctcggctcactgcagcctctgcctcctgggttcaagcaattttccttcctaagcctccagagaagctgggattacaggtgcctgccaccatgctcagctaatttttgtatttttagtagcgatggggtttcaccatgttggccaggctgatctcgaactcctgacttcagatgatccacccacctcggcctcccaaagtgcttggattgcaggcatgagccaccatgcccagcctaactgcacatcttaaaatataagatatatcctgttggttccagctgacttgtcccctaggaaggcacaggaatgcttcccagcatcccctcaggggattgtggggtcacccttccctgggcttgccccagcaccctgtctcactgcgctggccagctctgtcatttttggacttgttgcttggactcacctgagttttgcttcctcctctgtaaagtggtggtaaatgatacctttgtggtcccagcgtgggtgggtgtggacttggttgagccaagtcatttgagggcctcggcaaggtgccccaccgaggtgggggtgagagtttggagaaagtggtgatcaccttggtgagagcacaaactggagatgtagctgaaacaaaaatgtccttataaggctgttattctagcaaaaatgtgttaaaaattggttattggaaacacaaatctacaaggacataaactaaaagaatgaagactctactgacatgctctctctctctttttttttttttttttttttttttgagatggtgtatcactctgtcgcccaggctggagtacagtgtcacgatatcagctcactgcaacctctgcctcccgagtttaagtgattgtcttgcctcagcctcctgagtagctgggactgcaggcgcacgccaccacgcccggctaatttttgtatttttagtagagacggaatttcaccatgttggccaggatggtcttcctcacctgacctcatgatccaccagcctcggcctcccagagtgctgggattacaggcgtgagtcaccacttccagcctctctctcttttttaaaagtattggggtcttaccttgtcacccaggctggagtgcagcctcaaactcctcctgcttcagcctctgagtagctggaattacaggcttgtaccaccatgcccagctaattgtcagattttttttttttgtagagggggtcttgctgtgtttttcccggctggtctcaaacttccggccttaagcagttgtcccgcttcagcctcccaaagtgctaggattacaggtgtgagccatcatgccctgcctaatatactggctttaaggaagctttcaggtgcccacactctgtcagacttgacttaattcttctaggctttaccaacacccccaaccccatggttgggggtggggcattacaaccaggctgtggtcacctctgaggcacaggtgtcagccacaatgccaccttttccggtgagtcagcgagtttgtctggaatacccctccgtaggtgagagccggggtcctgggctgggaccacgatgggccgtagcttctcaggaagccgaagctggccctggccagagctgtcttgcagacttgagatacagatggcttctttccccctcccgttttctttttgaaaatgtttttaactcggagcatgtgtcggcacggcgttctttccacgaggacagaagctgtcactgcacgcagcagagacactggttctgatccaaagccgattgtggcctgcttctgggtctaattatttggcaggtcaggtgctggggtactgtccagggtgtaatcaagactcaagcatttgggcatgggggtgaggaggaaccatggggaggggaaggaaaaaggagggggtgtgtgacttagcctgtccagaccacagagcgagtcaatccccctggaacagtggcgtccgctgctctgcggggagggtctgcccatgacctggtgtgggagccgaggccgccaccaacttgggcgcccagcccagaccctaggagagggaggagcctggagcagcctttccctggcgagattggccacattccattttcctctctgaccagagagccctctcacccctgggtgtacaggctctttccgctaacagaggccctcctccagccccattgtccccactgtgagaccaggagtgcccctttcccagccccaaaaaatgagtgcgctcccagtgtgaggcacagagtgaaagcctcgtgttttagaacggcgggtgggaaggacttgatgcgccgtgttcttgcaggaagggcagggacgataccgccttgtgctttgcctggcacatggtaggggcctaggtatttgggcgaatggagtgatgtccagagaaagcaggactttggctcgggcaaggagtgggtggcagtagggaggactgtggtctgtggaagggtcactgtggctcttggctttctcctactgtccctgccgatggtgacagccagccagcctcctggccgcaccattgtaccgcctctttcttggcttggtcctgggcgtggatgtcagatttgctttgttcatgtaaaatgtggtgggatcatgtctccctcaaatcaaattccaaccaaaatcaaaacaaaacaaatcaagcgtctcagtgaagacagccctgagggttctgttgtctcagcctgggagcctgggagcctggtcgacctcacctgcttttcagattttgccatgtttattgcagacgtccccgtcctggtgctggccactcaccttcattacaggttaattctcacaacctccaggtgtggtatgcagtggttttaaggaaagagaaaacagaaaaaggccacacaggtagggcttcacagcatctgagggcacccagggtggccgaggtgtgctgctggcgaaggccctcctgcagactagaaaacccgcatgtcgctcctgcgtagcaagtgtcatgtctgttactggctgacactttgagggtttttcttttctccaaataaataattctttgtctctcttcagggtggcagatcggggctggagggaggaagccatcaaaagcaacctggctgactatgaacaagtgggttggggcggggacctggccaggcggtggcggggccaggagagccagcgtcttgtgtctggcctgggtggggagggtgtgggagacacctgaagccacctcggaaaatgttcggtggggcatttcttgcccagagctgtgtgagtgaaatatttgactaaatggggagttccttcctcggaggaggataaagcgggctctcttttcctgtccctttgtctcttgtcccctttgtcccagccctccagctctgcggcctcccctcccccagcggttccttcctttgtgcccgccggccactcaccagtgaaacttaactcagccccgggcctcactcccctcgaaacaacagaaggagctagtaggggcaggcctggctgtcagcgccttggactaaaaggaaccaaaccgccgtcccagcccccaatggtggcagttaattttgaagtttggcgttgactgttggcagtcccttccgagggagcagctttggagggggtgttgctgccccagccagagggattgggggctgtggctgaggccaggagacctggccttacacccctttccctggtaaagggccctgggttctccaccacagcccctctttgtcctgctctgagtggtttggagttctttgtgcagtggcccagaaatatggacgcgcaaactgtaacagagccccacccacacctctgggtagcgaagcacccatatttgttacatgattgtcttaatcctctttaagcaaggattagcgataactagggggttaaacaaaaatcagaaggaaaaactgtaagttggggaaaatctatccatgaaagaaagttgatgagaatatgggaaagttgggctggattcagttcatttgttataaaaatgggaactctggcaccttgtttctaagctgatggccagaggtccgagggcatctgctttttggggttgtgtggcctgcacgtcaggagagtgcaggggaccggggcctgtagaggttccgtagacttggtgtggatttgtgctgtgttgaggccgagcagaattgtggtgaatcggcacggcttcattattgctggaagtatttttccttacttaaaatatctaatttatttacccatacatgtttaaaataatatagcagataacatgtaaatttagagatactatgttccaccctaaatttacatgatatattttattctaggtcttcatatgcgtttttgttatcagtgtcttaaatgctgtcatcaaagccagtttttatcttctaacccacctttctaggacgtatcaccaacactccaagttgtttgacatatattatttttcagctttgtgtatgatgcttcctctgggaattttgtcccaagccacaggaatccattagaacatttaaacagtggctttgtaaaaatgtgtcttataggtgtctgtcgctggaaatgctccagcagatctgagatccctgctatgatgctggggggatgggtagggaggcaccacccttcctgagtgttaagagcctggctgctggcgtcctacctcaagccacctgtgtgaccctgctcttttctgcaacctcagtatcctcatctagaagaagcagacaacaatgcctagagctcacttctcaggattcagtgtgtgtgcccagtggcctgtatacactcagcactcagcacactgaggttgggctgttggagcactcctgcccttcgggtttacggagtaaccttgagggcttatcaggcagggcctggaggcagaccttgtggggaaagggaggagcaccgtgggtttcagttttgggttttggagtggggaaaccattccaggggaaaggggtatgctttcagtaatggcgatgaggcctgtggcaccctcaccccatttattgattgcttgcctttaaccgtagtgtctttgccagccctctggcatttccggagtggaatgttttaaatgcccttgactgaggactgtgtgtcctggaggtgagagagggccttacctctctctcattctgtagaaaagctttgtcatttaatgctttttatttcaaagctggtaaaaacttacctggacttgtaacagaggggccaggctctttgtgtgtgagtcatcattgtcatggtcatgacttggtcacagggtgacagatggtagccacacccctaggcctcagttgggacagaaactcctgggatgggcagtggcagaagtgtctgtcaagggtgcccaggttgtcgggacagatttgcatcgccgtttgtaaataagtactgctttgaatatctacctttgatgcgctggtggtggaggagctgggattcccaatttagatgtttgatgtaatttgaaactgaaacaatcaaaagtctatctcatgaagaagaaaaggagggtgaaagcccccctcctagaagttgtcacctggctgagattttaatctgtgtggtttgaaggagtccaggctgaccatatgttgaaggccctgccccaaagacgagtttttccttcacattattgcatttcattgagagaattagcaaaatgaagtcagagcaggcagcgtgtcttgttacttggtggagctgtaagggctgcgtcttcaggttgggagcaccattccttgactcaccattgctggtggccaaagcaagaaatgggtagtgggtttagaggctggcagtgttggcagtggtaacatgcctaaaagtggaattgtgtggactaaagaacttgaggaaaggggtagggtgggggcaggttttttcctgaatgggcaaggcctcagggccactatacctcttagaggtgtgtgagacaaacacacacacacacacacccacgcatgcacgcacacgagtgaacagggtggaggggagaccagagactaagggaggaggagggggtccaggagtggatggctgggcttgggggaggggtccctgtttgcataactgattgttgctcctgggtactgtggagtgggggaagccagcacaaaggctctttcctccccctccctccctgccctgtatccctctacctctcctacttatccctctccttcctcttccctgctctcctccttcccctccctttcctcccagagcctggtcagcaccaccttgtggcccccctgggcagcggatggcactgggctggccttgcctttgcttccctgcaggcagggtttgccaccgccagggccctgtggcaggcagggccaccgcagccgcctgtagcgtcaagataaagtccagtccagaggaaggctctggctgtgggtcaccctttaaaggctgttactttacatagatggcttctatgtgaactctgaggtgctcgcccctcaccatcctttccaccaggcgactggaggcttctggagggggactggctgggggcgcctctcatgaatggtttttctggatcctgtctcctgggcccacaacttgacactcttgaagaagcactggagtcacagtcagctgctggtgtgaaagtggctggcagcaggagtatactgtagcagcttcaagcaggcctcagaatgtggatgaggtggaggtgcctgtggactggcctgtgggaaagagctcagagcagagtcctctggcagaccccagtctggctggtccaccacacatctttgctaaataaataaattgaatgcatgcatgcatgcatgcatgcagtgtgatcccccccaagtaggaatgaataaattcccctaggtggtttgtcatccacgtgtgggcttttctatctgatccttagtttccctgtcagtcccatggtggtgacttttcagcactgtcaggctgtctgatgatggctgttgtgctgcggagccctccaggctctgaccacggggtcctgcccaacacctggggacacagagacagaagcaggccctgtggacagctagtggagaagacgggtagcatgtgcagggccaggggcatatcctggcccagcctcctctactgccttttttggcttgccccaggataaggttacagattgggagccaagactcccacagtgacggggtggggtgttgtgcatcttcccacgggatgctctcgtcccctccccctctctggcccctggcctcctgcccacctgagtggtgcttgtgcttcggctgtatgaccttttcatgaaatgaaaactaaagaatgtttttaagcaagttcatgctctggaagtcagttagctcacgttgatagccctgatatctcacgttggattaggtggggtctgcattttacactctgtctgggttcttggggtcagggttgtgtgtggttagcatggatttgctttgcattctgtcccctgccaggtggggtgggggatggagggagaaagggatggggacagcttgttccacctgaacaggcttcactgattgacttgcttcttcaccttggcttctgtgaaatggggataatgtaagcatccattataggatagttgagggtggtttgtgaacaaatttcatcctggagaatgtgaggtgtttggtgtcagttctcctggaaaggcttggacaggtcaagaacttttagatgggaaggagcagggccagcagggcctcaagaaagtgtgatgcccttttggggcttactgaagagattaatgacaaaggtggtgtgggatgacctgggatgtttgctcagagtcgtcttcccggagcctgtgctccttgtgagtagcggcaggaaccagggctgcaggctgcaggcctcctggctacccagtctctggatccccaacacgccgtgggctgccggccacctgcctccgcacacattcccgcgcacctgcgtcttacctgcccagcctgccttccaaggctcagtgtaagccctaacttctcctaagaaagctgccctgggctactttgccattctcaaagacaggcttccagccagtgcccattgggctctttgagccctttagtcacctcttcccatgatgtccttgtgcacggctctggagaagcctctgtaataacctgcctttcctgtccagcaggaaagagtctagtggggataacgggatgaacttcacactgaccgcagctctggtggtccagacgtgcacaccatgggaaacaactcatgtctcccacggtcagcccagggcactcagctcagacactttcctcaagcagcccctgggtgtgagtagggagttgggggcaattctgagctggtgtgccgagaggcattcctgtttttttttttttttttcttgaaacagggtcttactctgtcacccaggctggagtgcagtggtgcaatctcggctccctgcagcttccacctcccgggctcaagcaatcctcccccatcagcctcccaagtagctgggactacaggcatgcgccgccacatatggctaatttttgtatttttttttatagagatggggtttcaccatgttgtctagtctggtcttgaactcctggtctcaagcaatccacccgcctcagcttcccaaaatgttggggttacagatgtgagccactgcgcccagcctgttgctgtttttttcaaaacaactctttgctgacccttctaaatccatccagggcagccccagaggcccagattggctggattcgtgtaacccttctcaactctgtaactagaatcatgaagggtggcactcgctttttatagaagaggaaaccgagtcccagacagggaagaggccgcttgattgacagaaaggggccccagaggctgttgaaaatttcccttcagccgtcagtggtgggctggtaggtctcaccttgctcccaagactgttgccattagcaaccaacttcccctgttggttctgggggccctggaggggaagagggaagaaggtgaagcaatgctgtcaggtggcagctgagtgtctgtgccaggaggttatgcgggtgacaccaggaagagggcccaggcacacagagtcacgcgtgcacagcccgttggtttgctcttcatcattcccagccatggggaaattatataaagacattgcattttttacaaaaacatctccccctgcctcccaacaaaagaatagaaaaggaagaagattgtagaaaaagaggaggactaggcatagggtctgctggagtcagggaggctttgcccttgtcctggccctaccgttctccagctgtgtggccctgggttaattgcctggcccctggggcctcagtttatccattcataaaagaggggacagggtacaggtatacactagcaatacaggtgtgcagtgctcagccccatgcctgatgctcctgagccctcaggaaaggattgtgggtggaagagcgtcggaaacctgcagtgggtgggtttccagtcacgtggtcaccatttattgagtgtagcctagatcctgccacaggtatggcactagggggatgcagacttgagccaggattgtgttgattgttgtctggaacggcagacagactaattgacaaggtaggtggtggtcagtgctcatggggaacacaggcagagtttgaagggagcccagagaggggagtcgctggctgctttaggggctgggaaggcttcctggagggggtgttgctgctgggcctcaaggagtgagaaagaaagtggaggggaaggggcattccaggcaggtgcagatctttgtcttggaggattatggccagtgaacactgatagtgcctgacatttattgggctctcagtctgtgccagcccctgttctcagtgctttcaacatgaggtagtttaatcctccagaccaaccctgcaaggcaggtattaccccattttgcagttggagaactgagccacagagaagggaagtaatttgtcagggcttacacggcatgtgggactcagtctggaaacctttagagtcaggctcgggagaccaggcacatgcctagcctgccttgcctgacaggaacccaggtctggttgttggagatactcattaactagtggtttgggagagttggtgagtcccttccaactcagtttccttatctgtaaagtgagtataacccatgtccgtgaaaggatgaggttctcgggtggagttggctgtatgagatgtgctcagagagtgcctcatgttgtgggaggcccttccctcggttcctgtaccaggtggtggttgcagggtagaaaggtgtttaatcttaaggtagccactcccccacccctgcccgactgtcttcgtttttgaggccaggagcctgtcagctttggcaggattagataaaacgtgggcacggtgcccagtgcagcaccggcacatgcacagtccctgtacgcagttgtcatttttattattgtgtcttctctctcgatattgatgattgttaactgatggtcctctcatcagtcctatgggtgattttagcctcactttagaagaggcggtagcttgggggtggagagtgcatccagaggcaccatcattgcagacacactgaaacaccaaactgggtgtgtctctctcccattcctgtgcccgtgtcacagtagaggaaggccccagcaggcactccctatgtgttggcaaacaaggcttaaaatcgcccaagccttccccagagccagccttctgaagcaagtcatcatgtaaggtgtgacatgttcatgcacacatggcatccacacacgctttcttccacttgggcgcttgagctcatggtagtgtctactcagtccacaatggagtgttcctcggtgctggagttaatgcgctctaaacctaatcttaactctgagcaacttagtcttgtgagaacatgcagctcctatctgagaatagtgtttgcctgcagggcgacctgatatggctatgaaaataatgcagtggaacaagtgtctgtagctttggggtgtttggagacctttctcgtggcccttcagcatacccccccttgggtggtcttctggcagcagtcttgttgctcctctcccatccagccgccactggagagggggttggccctgtcttttcaatcactgagccctggggtattacagcatttgggtctcaggaccatgtgtgcttacggcacagtgctaagaacatcaggaagaacaccaaagacactgggatcccttgatcttgtatgacgggggaaccgttcccaagtctaaaattgagctgagccatgctgagggctgccaccactcacagccaccacacgcatgctcattctttgttgatttggaagcctcttcaggaacatgtagtgcctgagggccactcttgtggagaagaactgtaatcccttacatataataatcccctgcactggacactttgtagaacaatctcctgtatgtgagctcattggcaccctctagcagtcctggggcagtgacagacaaggcttattaccccgttttgttgataaaaacgcaggtggctttagtgactttctaaagtcacgtgtccagtatatgatgaagcaaagagtaaaaatccaatctgaaggctagtgatggtgcacaggacagatggtaaatgcttggcacatactccggcattcctcccttgctcgtgtcagacattgcaagttgatcacggtaactctttttctgccaacccgggttcagaattattttcagaacacagccttctagtcagccattatcaatcgaatagcatcgccatgcaaggtgagtttgttgtcatcggagtcacagaccaggctggaagttggccagtgatgttgtttcctggtcgtttggatttccagataagtgaaagttggatgcagacggtaaatgaattccatttggaagccctgtacctgcttgacagccagccaccagcttccaggaaggccctggaggatcttagggaggtgcatggtgattgactgaagaaggtttgcttgcattggagtgccaggtggtgaccctgaagaggacggagggttgggacaagctaattgtggagacatgatggaaccctcccagttgaaggaagcttagaggaggaaaacttctcttccaggcatcttgagttctactccacattttgatttctcttgggatgttgcaaggatggtttttcatatcacacaaagcttcatgggacatggggatcccgagagaggcagcagggtaaaaaaaaatggagcaatgttgtgcccaggataccgtcgagggtactaatcttgggaatcccatctcaaccaaagggacagggtcacgttctcagactggttggtgagtctgagtatctgattctgttctgagcgtcctcagactggttggtgagtctgagtatctgattctgttctgagcgtcttcgtacaccaggtttgaggtggaggttgagtttgaagttctcattcaagttgaaccttgaattttgcatctgcccttgtatagccagaccacaagaacagacgactgcaggacttcttcacctccagtctttccttcacgtggagacacagaaaccgtctgccacggtcacctaactagtggttctctttttttttgatcacataactcttcaaacattagccgatttcttgctgtcagcctccacgtggatattcttgaccttggttttcaagatgcctttttatccatccacctagctgcacagtccctctcatctcccccagcaatggtcaccctagctccctgccttcctgcataggcaggcctcccagtttgtgcccccccacccccgtccccccaatcccgtggagcctctgcgggaataagttcacctcaaaccctcgcctttcccagggagcctggcttgggccccccccccgactcaagaggactttttcccatgtgcaatgcagatttaaagaaaatcaacggtcgcagtttggaaggaccacacaggacataggtttcagtggtttctgacttactttttttcgttttagcagaaagagcttttctttaaatgaagtcttacgtggaagtgcaaataataaaacaaaaatggagccatctacttgttttaggggagtgtggtgctgtgaattctgctcactgggtttcccacctttacacctcccctcatgcccccaagggttttacctttgaagagagcacagatctaggtacctctgatttagtcagctcccagttggagaagttgtgtctagaatagagagacgacttgcctgaagattccctagtaagtgagagccacgggggcccccaggcctccctgccatatccagggtgctttttagtctatcagctttcccagctcttcagtgagatgttcaggcacatttcaataaagggtctatagccagctctttgtggggagtggaaagagtgaagcagcttctttagtgtagggcttctcagagtttctagtgtactagggtgcattgcagatctcagaagtggagtagatggatttaaaaaaagacagtaattctcacacctgtttattgcaagaccttatctggttaaataatcctaaaatggtttcagaaatgcttcaggcaggtaatgagttgtgagttggtttctgattttttttttttccctaaatgtggggaactatgggtccagttggcaatccacgaacaagtcccttctccctggctgcagcatagcatctctgtccttgagagcccctgtttttcttcattaagcacctattttgatgttaggtgaagggctcccatgggtccctccatgtcattaaggttttcttttttttttttttttttttgagatggagtctcgttctgctggagtgcagtggcgtgatcttggctcactgcaagctccgcctcccgggttcatgccatttttctgcctcagcctcctgagtagctgggactacaggtgcgcaccaccatggctaacttttgtatttttagtagagacagggtttcaccatgttggccaggctggtctcgaactcctgacctcaagtgttccaccctcctgggtctcccaaagtgttgggattacaggtgtgagccactgtgcccggcctaggttttctatctttttaaatgagtatatgttatgcttcttggatgtggcataattcaccagttccttactattgcttgtttccagttttccagttaagaattcttttgcattaagattcttttcagctttctcataatgtaaatagtaatgtgatgaacatccttatggctaaatgtttgtgcacataaacacaatggtattcttatgtgtaaagttgttggtccagtggtacacagagcacactttagaaacaaaaatccatcagaattgccagcacattgcttaagagtgatttgagttttacttcctagtgttgctcctagcaaaggtggggacccgccgcagaggcagcctttggcccaggtaaccagtctctgggacatcagagaaggacctcatgtagcttgccgtgctgccttatctggctagtctggcaccagagtgctgggactctgcccctcgtcctttctccactcattcttccaacactgcttgagcagtgggccctgtagggacttaatacatattaattgacagattcagatgcttttccctgtgtaagagctcagtagtggagacccatttgtctgaatgctttttacgtccctgaaaccttgcatgagaggcacagattggactacagagacaatggggcatcagggaccttgttcgcaagaaggtttctgtctctgcttttattgcctggatcatgcctgactccaaaacgatggctggtattctcagaaggtgagtatcagggcgggggtttatgggcaagagcgattggtggcattctcccccgcacctatcttttgcccaagtagatcattttggaaaagaactggcttatggaggtagactaggattaacccttaaaaaccagctcagactccagcagcaaaggaaagaggcagccctacttctggcctctggtatgcgtggcactgtatcagatctttgcatgctacttcaggtgatccccatgagaacccgcagggtaaataatagcacagttccctttccagcacgagggattcggaggctctgagaggcttagtgccatgaacagtgtcactcagttgtaaatgggagggggaagtactgagactggaagccaggtttgtctgaatccaaagccacttcttaccaagctttcggtccaggaagattgaacgcttctaaagttttattagaattcaatcagaatggtttcaaagtcttttgtaggaggtaagtttaacatgattctttatactaagccatttatttttaattattcaagtaatacctaagtacttcttttgttaaaaattgctaaaatatagaggtatataaaataagaagtgaagcaaaactccctgcccttcactgtcctcctgtgcatcctggtaccaggtataactagttggaggatgtccttctagacctttttctgtgtgttcacatgaattgatacctgtcttgattcagccctgaaagccatttcagttctgaatgaaggcccctagtttactttaatttcagcaaaccagaatttaatagcagcatactagtctgtaactttgggtaagttgcttatcctagagagatcaagcatcacattcctcatctgtatacttggggtgatagtcctagagtatcttaggactgttgagaggtaactatgtaatggcccagtatatggtgcaaatatactgtaccaggtactcaggaaagggactggggactccgcctccatgctgcaggaatgggtatagttagtactctgccttcagagtcgtgtgggcaacaatgatgaaaataggcatgagtaaagataagctataaatgccatcagaggggtgttagcagcagctggagctccaggctccactggggagcagttaactcacagagggaattaaggaagactttctggaaaaagtaccctccaaggaggggtggggaccttaatgatactaattcagccctgcctttgtgccaggcagtgttctgagtggtctgtgtaaactaatttagcccatatcagtaactccgtgaggtcagaactgcgattagtttcccagatgagtaaacttaggcagagagaggttaaggaacctgcccaagtttatacagctagtaagtggctgagacaggatttgagcataggcaaactagttcttctagagtcagtgctcttaacagttaggttgtgcagcccaccagatttcaaggaaagaagtgggccagagaagcacaggaaccagtgtgagcaaggtgcagggtgtgcagaagctgttggcagatccagggagaaggcaggctttccaggtgagggggtatggccgttcatgacggagctgggtagggtgactgcggcagacaagggagtacctaggatcaccaatatctgatggttgggccacgcccacccagttctgtgacttgagtgggagggcatgtgccttccctcacatcgtgccagctcctaacctgctcaggccacttagtagctcataggcagcttcgtgcttttctgcgccccacttgttgcctttcacttaggctctcaaatagtagagtattactgtcaatgttttggttactgcatttttgaaattaatttaagaaagtcttaacactgacacttcttaaccactagccttccaacacacacacacacacgcacacctttcttcagggaaccaggttggtgacacgatagagcatgtcctcaccctgtcgtacctgtggctgccaagggcctttcgacattgtgtgtgatgccctcgctcttagattgcttcaccgcatggcacaatggagcctctgtcaatacggcagctaattaattttaactttgggatgttgcttcatctccatgcaccattcacattgtctggtgttttcctggtgcgggtgcaaaaaaagctcttcggcgcctttgtcttgttgctgaccctccttctcagcccctcttccctccctcctgcccctctgtgcaggcctggggcctctccatctgcatttccctctcagcctgattttccacagctgttttgggggaagtgctgggcattccttttgggagaggtcttaattattgaaatgttaaaatgtagcacaaaccccgctagtttggactattcacgggcagagttgtgtgagaagcagaaaagctgacgttgcaggtaatggggagagaaaggctgtttgggttcgatactgccaagttcaccatcattgctgagaggaggagtggccatagtctgggcagggagagaggcaggattgatcattagcacacgtgcttttgggtgtgtggaatgggtatttagaaagggctgaagataggctgcccttgggatattagtttgcttagaccatcccatgtgctcttcttcccctccccatttttcacatttctcatgttaagcttgagccaagcattaatgtttatttgtgggacttgatattctatttatattttcccctgctgctggtgttttgttttgagaagcctcaccccttcctctttgttaaacagagtgctaggttgggaggcaggtgggacctcagtccttctagcagactggctctggcaggtcatctccccttctctgggtctcagtaagcatttacaaagtagaggtgctgaactagctgtctttattctttggaacctgtctattacggcagcctttgtgatggaatgtacttgacactagagtagggtttggccaactttttctataaaggaccagagagtaaatatttcaggctttgtgggttgtgcagtctctcttgcaactactcagctctgccattgtagcatagaaatcagccatagacaggacagaaatgaatgggtgtggttgtgtcccaataaaactttatttacaaatacaggtggtataagtaaggcccttgggccttactggtttgccaacctaagctctagagtgttctctttggctgccatgatgtcttctcatacactaggctagtctgtaaaggaagaagttcttctttgaattagggaccaacacctgaaccctcctgaggcctggccttgccatgaatctggtctgccccctttgtttcccctctggttgctggggaggtggcctgtccaggcctctctagggagccaggtgtgcctagctctatgcaaatcaccctgttcctgaagagttgtaagatttggtaaatcctattttaagtccgattaaggaaagtctctaccacaaaacaatatacctttccctatacatttcttctgcagtatacctttatggtggaaagaaaataaacaatggttgctttttaaaatttggttttttgttttgttttgtttttgggggacttttatttttacattaaaaaaatgatggtgcagggggtggtttcaggggtaatagtgttgttctccctcccatataacttatttttcagtctatttctttgagggccagagaagattgtggttggtgtgagagtaaggggcgtagagtataaatgaagggtaaatttgttgacttgtctaatttataactgtccgatgtggcatcagattgctgatttggtagcatagtcatctgtcataattttgaattgtgctaaatacttttgaattgtgctaagtactttttctccaggtgaagaaatactcatgattcacaccattgctgagagctgtgtgggtcttcccttttgagatggctggtagggagagggtacccttgtccccatttcccagattggtgaaacaaggcactgtgtggttaggaggtttgcagttctggattgaaagttcatgtggctgtgatgagcagtgtctgtcattttcccttggaaactgagatgtgactcagcaaacagtatccagctgttcaggggctgtgctagagtgggcttcttaatgcctggtgcctttcatcccaggaatgacctctagacagcattctatccacactgatggaggctgggaggactgcaccctctttccaagactccctgtgtaaatatggagtcttagtaagacaacagtgtctaagtatccctctgccccgccccccgtgagacagttcatctcccaggcctccatccagtcagattgcaactcctgggcagcacccagctcttataaatgcctgtcctcgccgttatctgggagagaaaacgaggggtaaaacaacaacaacagcccaccactgaaagcaggactaatccccagggcagtctagcgtgtggctcagatgctcagacaaatgtttagacagcttaagaaggtaaactagaacttacatgaataaaaccatctgcctggtctaagaaaaaggttagatttgggggcctgctattttcagatgctttcaaggccgggagcttatagggtgggggatataccactgagtgttccttcctggtctaatatcttgcgcctatgtaggggctgcccggaggagcccaggtcgggtagaggcttccgccttctgggtccttactcaccaagtagactatctgtggccataaagaggatttgacctgggtacctctgatcccatttgctcactaagtcagtctttccacaaagcaacccctgggggcccttcactctttgccaggccctttcttggggaagagaggatggtttgtggagagagagaccctggggactgctctgtctcaaaggatgctggctgatgccacatattgggcatgtggagatttgctcttagttgagcagctgcttgctgccaggatggtccactgctggcagggttactgagctcgctcttgggagctctgggtctagcatgaggagatgaatgaatactgagaaaagggagagatctttcttgctgagatgtttgtgtgggtgtgtttatttgtggtctcctacgcttgtccttaccatgatggtaaagatgggcatgaagataattaagatggcaggctgggaatgaaaagatacaaattctgaattttgccttaaaccacccaagaaatctttgccaggtctttaatacctctccttcctgaacttttaaaattacgcctccagtctctttctgggagagctttctgtggttgcaccctctttcagtgaggaagggagaactgaacccatggcggaaggacgatgacaacacctcccagtcagggacagttaaaaattagggcttttgccattaaatgagaatccacattgaccagtagtatcatcgtggtggtggggaggttgagtgtatctggcatgtctggaaaggccacttgtcttgattttggttgtcacatctgtctgctgcttgtagatgctctgttgatagataccactgatggtggccttgcttgttcagctcgctgccgggctttggggagcgcaaggggatatcccacgttctgcgagaacaggttccgcacctcctctctgaggccccctgctcaggaccagagttatccaagaggctctgtgaattccgttcagcctgggagggccttgctctattgggggcagtgtttctctgcttatcccacactcagcgggagtgcgtgtggggttcatctgcagcttcggaagggctcttttctttttagggttgttcggttttccacgtttccccatttctgctttaaacctctatctgtttaatttcctgagaagggagcaaaaaactctagatgaattaggttttatgaaaatttacctctttatagttagcacaggccaggttacaggatgtgaattttcataaaacgttatcttgtgaactggtcttgattatcctttgtcctgaattagcatctcccttctagggtagaagtaattgtaaggtttagagctggaaatgaagtaggtccctctgtgagtgagggattgtggaggctcactctctatgcaaactgcttttacatgcattatcttagttagttcttttttttgagacagggtctcattttgtttcccaggctggaatgcagtggtacagtcatagctcactgcagcctcaacctcctgggctcaagcagtcctcccacctcagcctccaacgtagctgggactacaggcatgtaccccttgccacatctggcagattttttttttttttttttaagtagagacaaggtcttactatgttgtccaggctggtctcaaactcccggcctcaagtggtcctcctgcctcagcctcccaaaatgttgggattacaggagtgagccactgtgcctggccacatgtattatcttacaatccaggctatgacctggggcatggtcccccattttgcaggtgaggaaattgagactcgaggaggttcagtaacttccccaagttcatgtgtcctaagcaaagctgttacctaaacattttgggctttaaatttgggttcttttttttatggcaccacactgcctcctagtttctttggtggaaacacttggggggacccatgcaggctttctgtgatcaaagccattcccaggccagtttacctgggtcacaggctttcagatacattagaactggctggggacccctgagccccttccagcgctgttattctgtagttgagaagagatgttttagagagtgaagtgattgccaagattggacagagaatttgtttgctaattcttttaggtatttgttgagtgcctatcgtgtgccagtattagaacacatgataaagcaatgaacaaaagacaaacattctgatcttcggggagctcaagtggaggtttccatatttctgtgctctaactttcctcttcctccctaagcttctagacagctcttttgtccctctgtggactcagggaatgcaaagtaattttagtataatgttttttgggttgaactgaaggagataggtgaatcagcagaggaagagaagttatgtaattgattccaaaaccgagagaaaagatacttggttggcttatttgtttttaatatgtattctttttatttctttgagcacatggtatatgtcaggtactgttctaggtcctaagaattttgcaagtgaacaagactctgaaggtgttggcggttgagtcacacacccagtagtggtgggaggtcatggtttgactccttggtgattatcaacccatgatctgaacatttcttcaaggtaggtgagtgttaactggtcacggtggtccccatttatcctcagcctgtcaggccagtggtgttgctgtggggtaccaagatggcatcgcaccctcctgaaatgatgaatgctcacctgctccatttctgctctctgaaacgtattttctgattctttgctccacggaagtgccctaaacattggagtttttacataacagcttttcttacttatccagcatttctgtcaccacctgcagcttttgccacaaaaacacagtgacctctacagccgggaagaagagtaggtggagtctggccaaggatgccagggaaaccttatgtttataaaaagctctctgtaggtcagtgagggcatgcaaaacctttccatgtcctctgtaggaatcctaggtgcttttttaaaggaaagactgttttaaagcgtgaagggctttgagttattttcccattagcattttatcagtcgataacctctaaaatcccttctgactatgagagtctccctggccctggtttcttctgcagcctctgctttaccttcagtgatggggaactcactaccagacagggtagcccatttctgttttagacagagcagctataatctgtgttccaggtattaccatcaccaactgggaagacttcttcctatgacagcttttttttttttttttttttttgaggggagggtaattatagcaactcatatatgtctctgttcttcccataaaactctccccacctccaccagtgggtttacgtttaaaatagcctctgttctgttttggaaggcatctccctggcttctggtttgccaatgttcttctgataatgtgacttccacaactgacctccaacccccactttttggcctggcccctttgaagcgcctggagttggcagagggagaagtgtggcgggtggaagacgctcttgagtcaggagctggcggtgatccgctttgctctgtggtaggtattaactgcgttcccaggcctgtttcctgctcccaaatgccaacatccctgcctcttaagtgaggtttagcttaatccccaaccttacctaaatgttatttctttgattattcagagctgtgggcggaatttccctgtgtcgttgagagcgtaggtggggacacactgctgggatgccctccccacttgcaatcctctcttgcatccatcgtccccacagcgctgtccagctaggatggtactggtctcccagtgttgttcgttcggatgtcttcagaggtcagactgggcatcctcctcactttaccagcaggggatactgaggcccaggggatggaggttatgccatctccccttctcctgtcaagcagctggaagccctggagcaaggtgtgagctgcaaccctggagaaatggtctgtagtttagcagttgtggagttgctcacgaagcttccagttggtcatccagtcagccggcactgggatttgcacagaagccctgagactctgcccttgccctcctggcctcctgagctgggtgggctggttcagcttcaggggaacacctgataagcccccaagagtccaccgtatctaaatactgagggtctgttgcacacaaggtagaaatggagcccggtcagagtatggcattgagttgccagttaagaggtactccttgaggttaggcaggcgtgttagtcttcattttgtatgtgcagtgcctggcacatagttaagtgcccaatgaagataagcttggtggcagcctgcccatctggtgggttaaaatggaaaaagctccttcctttttagctcgaaaatgttcttagagctcctgtcctgtcccagatgctgcagagggctattgaggtgctgtctcagccctgcccacgagtggattaaggaaggagacccttctgtaagaacactgcaccctcatgcctggatggtatagtgtaggtgtggaagtgctgtttgtccatcttcctttactttggagagtccacctttgatgggtcctctggaacctgatgactgctgtgcatgtggaaagactgggaggcaggtgaacatgctagcaaaaatcatccctgctccctgggtgccaggccatttgtggtgtgtcttattacttggcaaagaagacattaggacttcatttattttgtgagagaaaaggtcttgctatgttaaccaggctggcctggaactcctgggctcaagtgatcctctggcctcagcctcctgaatagctgggactacaggtgtgcactgctgtgcgcagcttaggacattaggactttaattcactggactggatttcaccccatgggtcccctgtggatgggggagaggtggaggtggtggggctggctggggagcaggaggatgaggtggcaaggatgtgcagggttgaattttctctcttttcttcacaaatagtgctagcacccttatggtacaccctacccccagcccccaaaaaacttactgaagcactgcccacccccacattgacctaccttccttctcctgcctgcctgactttgtaagtgagcccctagctttttgtcaggagtgggggtgtggatctgtgtgtagcagggtggcctcatttgtcgagtgcccaccctgggccactgtgttaggcagtcacgattgctgcaaagcctttaattagcgtcccaggttgcctggctgccttcctcactcgcactgcctttttccttttctcccttcccctcctagcccctttggccttctgtctcctctcactggggactcagacctctcttcctgtcttccctccctcccttcctaggggcctttccttgattctctggggaaaccagataggcctctgttacccctgtgagccctgttccctccacccagaagatgtggagtgaggtgaggggctctacccccagcggtgagactgtgtcaggcctttctctgcgtctgtgtgattttatgaagtctgtcttgtcaaaaccaagaggctgaggaaagtccctacatttattctttgaagatctcttgaacgctggttgctgagcacaaagcaggtggggcgggtggaggaagacttcctgaaatggagagaaggcgagtggacacccgatgacttgtagatatgtgggtagaatgctggagggagaagcggctcctggggcacccgtgcttggccccctttggatgtcggctccctttgcagctcctaagctctgtgtttggggtgggagcggctgcgaggcggtggggggcttgtttggcagacggcgcccatcagacaactggaaagtgccagtgcctgcgtggccatctgtccccgccgcctagctcccggccgccttctgcttcccacagaagggcccgcgctgttctgtagcacaagggcacggggcctggccgggaggggcaggcacagttccattttgccattgtttattcccatctcctttgcagctcctgcgcttgggagttgccaggtgcgtgaaaagtttgctgcgccgtggccgatcaggttgtttggtggggcgctggcgggaaggaaaggtggaagtgtgcggcgtttcctttgcaccgtgtctgtttgttcaactgtggactttcacccctccccctggctgctggttttcttttttcttgctttaatttgtaaaaacgcacctagagcaggccagctccccgggatttgggctcatctgcacgctaccctctccgagctagttaaagggttaaaaattatggggaagttcagccggcacttgcaagatatggttgccgtagcaacaggccttctaatctggtaggtgacctgagagactggagaagatgtaggggttggtttggcatttcattatttcatgaggctgcctctccagctggtttctctgctgagcttaaagcttgctgttcctgccactagaattactggcacattccaaaacaacagtgttgatggcacgagcactgcgttaatggggtctggccaggcagggtgggcggaggagagggagctgggttccaggagccctcacgtgggatcgtgtcccctcgcacaaagcgggaggtgtggatagagggatgtacgcaggggtttgccctcctgcatacaatagccgccttcttgaaacaccacctcacgtaaagagggactggctttttaggaggactttaagataactcctttagttttccaagaagcctccttaaatttgggaggcaggggagctctctgaatttgggggagaggctggacgcggtggctcaacacctgtaatcccagcacttcgggaggctgagccgggtggatcacttgaggccaggagttccagaccagcctggccaacatggtgaaaccctgtttctactaaaaatacaaaaattagtcacgcatggtggcacgtgcctgtactcccagctacttgggaagttgaggcgggagaatcgcttgaaccagaaggcagaggttacagtgagccaagattgtgccactgtactccagcctgggcgacagagtgagaccctgtctcaaaaaataaataagtaaaataaatttgggggagatctccctgtaatgtctgtggttggtgccctcctcttgtatttatctccagatagatattgtccagaaattcggcttagttgagcacagtagcctcatgtctgctgtgtgcccagcacagagaggaacaggacagagagtgcctggtctcattcattctctcatcagacgtttgttggacgccgcatgtggcaggcattgcagagaaggggcaggtcacaccgttgtcctggcctgagagcctcccattgtgtgagggaccttcaaagcaagagcaggagaggaggaggaaacaacccagcctcaccctccccttccttttagagggaccttgtgtcgagggcagtaagcagtcttctggccttggaaaggcatgaggcattcatgatttttcattcacctttctcttttctacccctttgctcttggctgtaattactgggaagtccacaggctgggtagatggcatgtacagatgatgtgttctgaagtccactcctccctaaggcaccgtgtcttaacacagagttgtgtgttacattaggcccaggttcacagggatctccgattggttggcttcctgggtttcttgttttttgaatttctttcccctggagaggttagtgttcctgggatttgtgagggagcggggagtgggctggagaggagcttagagtacttactgggacttcaggtggctcactccccctccccatctcggttgtaagctcctgggggagaggtctgtgtgttagaggcccagcaggtctttgtggaagttccttgctcccacgttagatgtgaacgccgagaaccacatgacaagagtggtagtgtgtaccctcctggggctctaggatccagcagggccacctccccacttcacccactgcctcgtgtctctcctgtagttctcgggtttgccgttcagtggggtgaccctcagagtccattgagggtcccagcattggcttatgttttgtgggattgggtggaaagacttgcctcactgtaccgtgtcattgctggtctgtccacctgccctgcatgtggcaggtgcctgggaaaggctggcatgtggttttgatgggtaggagtttgaggggctgggaggtgcactgatgctgcagaaagcagagcagacaggcagccttgtaaggctgtagagtctgcagacagtggtatgcgctggctccaggctttctagataagatcaggttgcagatagtgaaatgggagtcccatcttttgttgggcatcctggtgcagcattgggatgtaggagtgctcttgctgagccgggggagtggtcagtcactgacagccctggatctgggtccagttcggtttctagtccctgtatgatttggggagtcagtcccctctgtgctgcagtctcctcctcatctgtagaatgaaggtgctgacctgatcatctgcagtccctctcagtccctcagcccatgtctggatggaaagagagatctcagcagagtctatgcattgctggacctcagactggtttcttggtatagaaggtggctttagggtttatctggcttgtgtgaattttgccccattcagtgtagttccacagggtttgctgaatgccactccccttgccctgggctgcagcatgagtaggatggggcaggccagccctcgagagcagcctctgaccctgcctgtttttctctgacttccatggagcatgtgagagggtggccagaattgggatctgacaatgcacctgggtcacctggatacttgaaaacactcccattccccttctgggagaaatcttgacttggtggggccagcatagagggtgcacagggtttttcagagtggatacatctcagaggagcaaagggaaaaatctttaaggctgaagcttctgaggatggcctggccacatgtgtgtaagtcacagggcaggagcgggggtgttgagctgaagattttctggaacctgtaggatctgaaagtagaggtgatcttccagtttaccctttcagcttggattttggcctgcagtttttcccctcgcaatgggcctgatttcgacggaaagaatgggtctgccctattccaattagagtgtcagggccttgttagatgcaaaataaataaaacaaacttgtgtatccagctctaaaactggctggggccctctgagagttgtcctccctgtggcaggggtgtgtggggacctgtccagggagcgcctgcagctggagcccccgtgcaggcgaggaaaccaaggggatggcatgacggtctgaggacacggcgctgtccggtcgggccgcctccccgcgtcacctactgcctcctgtctctcctgcagttctcgggtttgccattcagaatccgttgaggggcccggcgtcggctcacattttttgggactgggtggcttttgtgctctgttgagagggatctggcttgagccccatggattgtgttgaggttcctctgtcattagtcatcctgttttagagtgggaaaaacatgacagtttactctcagattgaagtttccgagcagttgattgagatgggagttctgaggttttgtgttgtctgcacgtttctgttagcattgatgatggcagtgagcacagtgctgatcacgctagatgctcgcatggtcaaacggcaagacgcagcttcttcctgctgcacatcctgcaaggtgaggctcatgagatgacggccatcccgccctccccttgccttgttccattaacattactatagtaagaccccatatggatgactttctcttctggaggctgggaggtgaaggcaggggaggaaggggtttgaagctgagatgaagcctcataggaagtgggatgacccagtggggaccgtttctgacagaaggttcctcaggggtgttttatggagaagtcacttgaagaagccaccttaccagtcagccaagaagtttggatccatttggcctctctggagattgccacttagtaggataacaaggtaattccctgctaggtgaagtaggacttgaatcagttctatcaagcttcctaaggcaccttgtgctgcttccgaagttttaggcttttggtccttttatgtaccctgagccgtgtctagcccaaggctcttcagactgaggggactgttttttttggggggcgggggtggggtttggttgttgttgttgtttgttttgtagagatagggtctcactatattgcccagttaggtcttaaactcctggcttcaagggatcctcctgcctcgacctcccaagtagctgggactacaggcatgcgccaccaggcctggccaagatcgggggtcttcatgtgttttgccttccatgctgtggaagcctgttggtttgctggagttcacactgctctttagctcaccaggagctccttctggagaataaacatacagatgtttggatgggtgggtggatggatagataggcagcgtgctgagctgggccagatcgagtcaggagtccttcccagatggcactggggatgtttctacagctggtgtacaggcagcaagccggtcccaaaacaggggctcccataaaggcccagcgaggtcactccgtgggagtaatctgctagaggttcatccctgctagcttggcctgttgaggaaccctgtcttaggtgaatatcccacacgccagaggaacatgaaaagatgaaggaagattgttgttaaagtttcatttatatttagattatcataacattactcttgagatctgtgacttttagcatttgtggcctcaacaattcataagtgactggagtcatttataaccttcctgagcataacttgaattttggcccaggaggtaggtgggcccgtgagtcactgatatggtgggtcagcctttctggcacccccggctcttcaggctctgcctgtttcatacataatctaatttcatccttccggtaaccttgggaatggggtataattgctgccattttatacctgagagaacagaagaagttatgtgttctgtactcgttcattttgaaaagtaggaggaaggaagaaaagaaagtcacccaccaccaggactaactttgtgctaacttttcgagtatttcttttcaggctgttttcctacttttactttacttttttcacatcatcttcttctggtcagaaaattctcattataaaaaatagcatttaaggctgggcacggtggctcacacttgttatgccagcactttgggaggccgaggtgggcagattgcttgagctaggagttcgagaccagcctgggcaacatagcgagacccccatctctacaaaaaatacaaaaagattagctgggcttggcggcacgtgcctgtagtctcacctactcaggaggctgaggttggaggattgctgagtccaggaggttgaggctatgattgcaccactgcactccagcattggtgacagaatgagaccctgtctcaaaaaaaaaagcatctgagaagctgtgcgggttctatttctgtgtccagactcttgagtttatttacacgttgatatgatttttggatggtcatggtgtgggttctcctgcctgtccctgggctgctgctgcccccagggcaagaatggtttattcagctcagcttcccaggctgagacattcagacccaagcaaggcctttgtgtctaaagtagtagttgattggagtgctaatgaatcaattagaaaattacttgctgctgagctcctcagccaaacccgggttgtgcacatgtcttagaaaaccatctgaaggccatacgcgtataaatctctcttggctgtggccctcgtaaatctcaccacagcctttcttggacctgttaatcacttgagaaaaacaggactacttctgctttgcagggctgccttgtgcttggcacagttttctagcttgtacctcttccacggatgagaaaggagactagagttcctagtaacagcgcttgttccgcactttcaaaaagaagcattcaggggctgctcttgtgttttgtctctacagcaaccctgttgggaggcactattattattttgcccatttttatggatggcacagttggggctcagaaagtgtaagcaacctgttctcaggtcaccacctaaaaggaagcagcggtgaaggcttcagcttcccagatcttcacactgtcactctgctgagatgccttttcacgtggatgctcctacttaatatatcttggtgggttttcatagtcccaggttggcgtggcaggtgaggcacagccaatagaggtggaaatggtagaggcatttctggttaagtacccagggttggggtttagagcggtttaatttggggcagaagggttcaaatgacagccaacagcagaggctaaagggaccccaggtgggagatgtaccaggggctccagattgccagcaatttgtgttatgtattccaggacactcgccaggtaaggttgaacctaaaatggaaatgaggagaggagaggaaagttaaaagatgaaatggctatgaatcccagctgaagcgggaggcatttcttgaaaaagatatctgtaaaataatgattttgattttttttttttttggcccatccacactgtttcctcattggatacccacctcttgtgacccccagccatcatttcatgagcgaaactaaggtggcatggctaaacccttacctgcttcctgtaaaagccaacatgccttttcaaggctgaagcctgagggagctctgtgctggtctcctctttgattttggcttcatttggggggaaccagtagccttttgttcccaggatatgggccaaggctgcttgtttcataacttcatagtatgctcttctgtccccaagatggtcagtgtatcatgcagttttgatatttctgcatctaaccttaagggcattggatgcccggcagttgttttgctcacataacaaacaaacatttgggtgcctactgtgtgccaggcaccgctgtaggtgctgggaatgccgcagggaacagcagaggaatatccctgcctaccttgtggagctgacatgctggtggatggtacagagacctggttgggtctcaagctctgggttggaagatatgaccctaataattctaatctctcctccatagtggctctttttgatgtgcccaacattatgctgggtgttttatatttgttaatcatgttccatcctcagaagagctttgttcagacaggtaattgtcatcttatctttgcagacgaggctgctgagaacacataatgggtaggtgcttacctgtttcttgtcgaatgggtgaagagcagcagcttgctggtcatcgggctgggtttttagcctggttctggctctcaacaagacactaggctacctctcccaggctttaccggcctaattttgtgacttgccttgagtgtaggtgagtgccagagcaaggagaggaggtgagatttagaggccactcacttccgcagccctgtgaactcacttccaaggccttggccttgctcttccaggcacattggtgcctccatctgagctgtatctatggtggggaagtgagtgggatgcatctgccccgctgccccatgaccacagaccctaagctggcacaggtgaggcagcgtgtagaaccttgcaccacatctatctgcccagccatctccttggccttccagtattgacttggccccagcaagtccccggtattggaaatccaaaacaaataaagcccaacccctggacggaagtgggctggtattctcactgtgggagcttgaagtgcggcagctgtgtgggtagccagtgctctgggtgtcacctgtttggcaggctgttggaggctgtcccaggcagacctcaggtgtgtgagggagaaagttagaagcatgtgactggctgagggggcaaggcaggaggatgtctacttcctgttgttgcttgtgtgtcctcttgacccgcaggctcctttttgaaccttttcctttttctctttctttctgcccactctctgctaatttccacctgtcctcacccgcccccccccccccgccccccatgccttctatttcccaaaccttgtgggttacctcagactttccttggcggttctcagttggcggactgaggggcagagtccgccacccgataaagatgactttgtgtctctgtccccagatggatatggggactctgacctctccggatggtgtttgcagaaggtcgtggttggttgcacggagtcatataatcctgaagtggcaacagtgcacacagtgaggaaaggggtgggtgattgggtggctgagagtgttgagagccttggagtgaatgatttccagacctgttagttttctagacgcagtaacaaagtaccacaaactaggtggctttaaacaacagaaacttagtctcaatgttctggaggctgaaagttcacgaggaaggtgcccgcagggccatgccctctgaaggttctagaggagcatctgcccatgcctttctcttatcttccagcgttgctgcaatccttggcattccttggcccctaggactccaatctctgcctctgccatcacatggcacctccctgtgcatctcattttatattcccctcatttcatatggataccagtcattgcatcaggacccaccctaatccaatatcacctcatttttgctaagtgatacttgcaaaaggatgtagaatcggccttccacatctgcaggttcagccagcatttgcggattcagtaatcaaaaatattcaggggaaacaaaccaacaaaaagaatacaggcctggtgtagtgactaatgcctgtaatcccagcactgtgggaggctaaggtgggaggattgtttgaggctagtagttcaagaccagcctgggcaatatagcaagaccccatcttttttttttttttttaaaaaggggacaaattaaaaaacagcctaacaactatttacctagtatttatattgtattagatattataagtaacccagagatgatttaaagtatataggagggctgggcacggtggctcacacctctaaccccagtactttgggaggccaaggtgggagggttgcttgaagtcaggaattcaagactggcttggttaacatagtgagaccccatctctatgtaaaaattaaataaataaattagctgggtgtggtggtgtatgcctgcagtcccagttacttgggaggctgaggcaggaggattgcttgatcccaggagtccaaggatgcagtgagctgtgatcactccactgcactccagcctggtgcagtgtctgaaaaaaattttaaaatgtatatgggaggatgtgtgtgcactctgccattttatgtaaaggactcaagcatccgaggattttggtatctgtgaggtggggttggggagtaagggcctggacccaatcccccaaggctgccataggagactgtatttctatttttttttttttttccttgagatggagtctcactctattgcccaggctagagtgcagtggtgcaatctcggctcactgcaagctccgcctcccgggttcacgccattctcctgcctcagcctcccaagtagctgggactacaggtgcccacgaccatgcccggccaatttttttgtatttttagtagagatggggtttcaccgtgtcagtcaggatggtctcgatctcctgacctcgtgatccacccgccttggcctcccaaagtgttgggattacaggtgtgagccaccgcgcctagccaggagactgtatttctaaataagagcccattcacaggtactgggggtaggagttgagcatatcttttggaggtacacaattcaacccccagcatagggtgacagtgccaggccccaaatcaaaattcaaattcctgttacaaggggacctaaagatcttaatctactctgtaactttagtcagtacagtaattttttttttttttttggagatggagtctagctgtgtcacccaggctggagtgcagtggcccgatctaggctcactgcaacttctgcctcccaggttcaagcaattctcctgccttagcctcctgagtagatggtactacaagcacatggtgccgcgcctggctaattttttttttttttgagatgaagtcttactctgtcacacggctggagtgcaatggcacgatctcagctcactgcaacctctgcctcttgagttcaagcgattctcctgtctcagcctcctgagtagatgggagtacaggcgtgtgctgccacacttggctaattgtttttgttttgtttttttttttttgtatttttgtggagacggggtttcaccatgttggccaggctggtctcgaactcctgacctcaagtgatccacccgcgtcggcctcccaaagtgctggaattacaggcgtgagccaccgtgcccagcctaattttttgtattttggtagagacagggtttcaccgtgttgcccaggctggtctcaaactcctgagctcaggcaatctgcccgcctcagcctccaggattacaggtgtaagccaccgcgcccagcctcagtacagtaatcttctgttaggaatctgctctgtgccatggtcagggcttggtcaggcacagagactttgcttggcgtttggggtgagacgctagttacttctgtggaaaccaaggattttaaaggaaatcttaaaaggagatgttcatgcaagcacttcagagagggcctttgaaatgcggaaggcttttcttttctgccctattacttttgaggccagctggctcaggtgagattactcttccttctctctgaaggaaggtgtggggaaaggagctgggaccatgggcttagaggttcttccagtgccttggtcttttccctggatgggagggctgagactcgggtggtttttagagtgcggctcttggtgtcctctcttccaggctgccttggtagctgggaactgttttattggaagggcaaatattgcgtagtgtcaataaggatgttttttatgggggctcctgtgtttctgcagtggataagcatgaagaagccaagtgtaagttagtttctaacggctgggttcagccctttttcttcccttgcagaagtttcccatccgagcagagagaactgagactgagcctgctggccacgcacgagaactcttgtaactttctagtctccccgtgtatcaggagaatttccgcacagatgacaggagtggagtagaaagcatttgtagccattgtattggaggaaacaagtgtaatataaataggaagtctgaattatacgtctcctcagtgctgtgaggaaaaaccacacgcaccaaatgcaatttacagctgtacgcacgtggactaatgggcactgtctgccagcgacgcgctcaagcagtgggagaccttgttgtgttaatttctttctttttaatttgagacaatgtcttgctgtattgcctaggctggtctcgaactcctgagctgaagtgatcctcctgctttggcctcccaaagcattgggattacaagtgtgaaccacccaacctgagaacctgttctctgttgctatctctcatctctttgctcctttcttcccacccacaaaaacagaaaaaaagattgatcggatgtttcccccaattctttcctctctttacaaggccttgcctgtactgacgacaccgagtgtgttaagaggtgatgggattagctgccccagcagtcatcacggggaagcagagcccatctttatgcccctaaatgaatcacccacagaagtgtcttgaacatattcgaatcaccccattctctattcccaaaatgataccttttctgggagtggcttgaatcattcattctcaaaagggggcttcaagagcctactttgggcagaagcacaagtatttattatgccaagactgtgtgcagtgcatagctgtctttgtaagtagattggttttgtgtcttctttccagtggatgtatatgatatatgttcactgtgaaggaaattagataataaacgtaaacaaaactctggtaattccacttctcaaagattaatattgttcatatcctgattcatgtcttggtgtgactttttttttcctcaacgtttctctgcccttacaagctcaagtccagtagggtaatgtcagtccactggagtgactgagcccaggtgtctaatcaggggcacctcttggccatcatgccccgcacccccaggtgctacctcagttgccaggtactgagcttcccaccatctcttctttttctccttcgggtcttcttggatcccatggaagtacagactactcttcctcagtttcttgagttgcatgtcctcttctaaaattccggaacctgtgttaacacacttccctgctagtggctctcctagccccttctcctggtccaaagctttttgtgattgatgttgccaagaaccaatgtctttcctttgggtagacggggtggggtgtaatccttgctccagatcctagagttcaggactgctgtgccagggtgaccttatgtgtgtcaagtagatatagttatatgaagccatggtttgtaacctttatggggccgtagatacctgggagactgaaattcattgccctcctctctgaacactgcacattcacatgtattcaaataattgtgcgccataaggccaggggttggggtttgcaaaccctctgaagcccatccctgatccccttcagaggcagacctgctcccctgccactgggtggcctggacagctggcatggcctcttagtgtccgttttaccttcagtaggatagctacagtgatagtcaccgtgtggtttgattatagcagcagttcatgtctactgagctctgatgttgttcacccagtccccaccctggccccatgaggggaaggtactaccacccctgttcacagatgagcaaagtgaagctcagagagatgaagtgacttgtccagggccgtacagttagatccaggatggggacctaggcagggtggcttcagaacacatgccaaacacctgacacgcagcgaggaatgtatcacgtgttcaatacataaatggtagtagcaatatgaaaagcggcagagggttagggcacagcctcccctcttccccccacctgtcctaagtatccccctggtacaggatccgggctatggagctcgcaggcgggtggaggcgagcgcagatccgccaatcctgggaaatgtgtaaaatcctgttcctgaaaaccggccgggttctcaaagtgtcccggctggcgtgttttgctagtcacgaaacatgatccatacgctgtattttaggactccccatctgtcggcatcggggagcgttttcccttgaggaagctcaaagcgtgtcagctcactgggaggggaggcagcagaagggtctgtgataacagagtggatccagagggctggggtgtgggagactcggggaagggtcctgcccagggtgtgccaggtgcctttccgcatgacctcacataatttttacacagatccccacgttttacttaagaatactgaggttcagggaggttagcttctttcttgtccaaggtttcaaggctgctaagaggctgagcagcagagattgaacttgggtttttagattgcccagtgttctctgccttcccccagtctgtcccttttgttcctgggctttaccacggtaggtggtgaaggacagggtgtgggaggccttgcctgggaatgggagggggtggggagggaaggcataaatgcctggctctcaggcccactttgcagagagcccacacctgccctggccccacccactgctctggtcactgctggtggtagaggaagagctaagagggctattgatccacccatctcctcccagggagggagggccacacattcagggctttctttttaaaaatgcattaacctgaccgtaagaaggccctggtttaaaaacaaataaaaataagaagtgaaacaagtgggcgtgggggcaggagtggagcaaaccctttggaaaatggaaagggcatttgaggagggcactttgcgaagtaccttccagttccagacctggatgcctggactctgcagcctgggctgcgctgctttcctgtgccttgggccatcagtacctctcctggtgctctccgcagggaaactttgcccagatccagacattccaggaaatccctctgcgcgtggccttacacagtgtggtgtcagtccgcattttgaaagcctgccttcgtagccctgacttggacaactttgccctccagcctcctccctctttgccctccagccacattgggcttcttttggtttctcagaagtgccaggtactggcctttgcacatgctgttccttctgcgtggaaggtgcttctctccccctctctctctccctgctctccaggttagtacctgctcatttttcagacctcagcctacagggtacttcctagggaccctgtccggcccgctggctgggtcaggcctcctgtcatgtacccacttggctcccaggacttctttttttttttttcaatcattatactttaagttttagggtacatgtttcctccacaaccataataaaggaattaacatattttacggcaggtagcaattaagctctgggaaggtaaggactgggctatcctctttactgtcctgttcacttttgcccttggtcatccttgcccagcacagcacttactaccatgggagctcagtaaatccttgtggaatgaatggatggcaggtcggcatctattctctttggcccatggatgcagtttgggtgaaggcaaggaaataaacattataatcagaaatcactgtaattttttaaggtttctcaaggtatgggcccactgtgaggtcaggatatggcttcagagtggagcccccaacacattaaaggggagacgtctggccagcagtccacaaggccagggtgcttagcagcatcccagaacaggcagggaccttgaaaggtctctgccaacatgttgtcttggtaggtggaaagacgtggagcctagagaacagaaagcactttgccaagaccacacaacagtagggccttgggagacctctacttgagcctcagtttaattgcggaaagagagttaatccagcaccaggtgccagccggcttactatgcagacattgtttcactggcctggagagcgactcagtttggcagcaccgatttacagaggagggaatggaggcttgaggaacttaagttgctggtctcaaaacacagcagaggtgggattgaaattcagatgttcctgattccatagcctggttctttccactgccctgctttccagcagggtggagtggaatgacagccttgtttcttggattggctctggtggggaccttctgcctcctcttagccagtggggctgtacctacttgtaggagcctgcagccctctgggctggtatgggagtgtcctgggtgttcatggagtccattttttctccccaaccttgttttacgtcgtttctgtctcctgcctctccacctctgaaagaacctcagaaattcctttgtccccttatcagtcatttccctgggaagccactgaggatcctggaaaggtaccgagggtgatgaagcaaaatttgcaccattcccagagtaactttccatcatgcgtggctaaaaataaagtgtgtactcatttctccttgctgtgcgtggacttgcttttggggtttcacgggagccacttggcccttttgtccctccctccctgccacccctggacaggcatatgcccacaacttggggagatgggtgggcttgaagctgctcacatctctggagagcagaacccctgagcctctacaaggaagcacctctggctctcaatggcagcaaacaccacattggtgggttggcactttggcatatgcggggataccgactccctttgcaaatattactgcagccgaaaagagacaagctacctttagaggactttctttgtgcagggtgtttctttttgatatctggaatgcacagaggcaagagagataaaattaatttgttcaattaattttgtaaatattgactgaaccaaagttttatgccaagtcacatgtcagggacctgagagcttaccaaaaagcaaatgccttccttgaaggcgcttatcctctaggtgggggaagaaaggtgtgttaagaaagaagtagagccagagaagcatggggtcctgctcctaccccaccctcccttccagcattagtatatgatgctgaagtttatgtttgacctttccgcctttcccctttcgttctttcttttctttctttctttgatggagttttgcttttttgcccgtgctggagtgaagtggcacgatctcagctcactgcaacctccgcccctttggttcaagcaattctcctaccctcagcctcccaagtagctggaattacaggcgcccgccaacatgcccggctaatttttgtatttttagtagagatggggtttcgccatcttggccaggctggtctcgaactcctgacctcaggtgaactacctgcctcagcctcccaaagtgctaggattataggtgtgagccaccatgcccggctgatctttcccctttcttaaggcactagagattcccctctcctgcaatgatgtttttttttttagtggttactatgtgctagggctaggctagtattttactcgcatttatttcatgaactccgcaagagcctgtgaagtaattactgctatcattcctgttttctggttgatgaaactgaggcccaaggccccatagctaaaatgttgcagacaggattcaaatctaagcagattaatttcagagctcacgcttctaaccattagctgtatagacacatccacactgagaatgtgtgtctgccaagaatctgctatctgtccagcatcaattatcctcaataagtgctttctctttaaaaatcttaactatgctttccatttaatccttaacattcctagtaacccatgggataagataagacccccttctcccccatttcctattctttttctttttctttttttttctgttacagattgcaccaaatggtgataggtgaagggtctctggagagggcaggatactttggaggctggaattgaaccatgttgtcttaatccagagcctgtgggagagagaaggcccatgaaagcactctgcagactgtaaagtgctacatgaaataaaaggcatgtgagaaaaggtgtgtgtttagaagactagctttaacttggacctcgtgcatcctatttggggatttcttgcaccgtcgtcatgatctggtttcaggtacctgtgaaaaattatggtaattaaagtataatttagaataccctgttggctcacagcagctggtccagatgtaggaggctggggctgtttgttaggggtgtcactctcttctgccctttgtgttgttggggagaagggtgggggcaaagagatacaggagctatttttacgttgttcacgtcatattcagaattactggatgcttgtggttgggtccctgtttagcctcggctgggaagagagaactcccttggctgcctgggtatgtatggaaacttgagctcataccctttagtatatatattgccgtaaaggcaaatggacgcagagtgaccggacagttaccctgaatagttggctgagattttccattctcttcagaatgcttctagcgggtggagaaagtggggttaggggtcgggagtgagagggcgggaagcataggcgggcagccatgtgctcatcactttggttatttattcaacagatggtttttcagtgtgagatacatgctagatcttttcccaggtatttgcaaagtaaagtagaataaggtattgtccctcaaggattttacagtctagttggggaaatggaaaaataaacattcgctttagcatatgcaaggcaagcatatcagcccgccctgccgtaggtgccggctatgcagccccattgcagtaggggcaccgaggctgtgaacacaggagagggacacctggaccacaggggcagtcacaggcaacttcctggagcaggcagtgagtgcagaagctggcttcacaaactggagaagcacttccggtttagttgctgttgagtgtaatatacacacatgatgtcatggatggttacaatcattatatctcattttatttctcagtcggcctgggactttattctcattatttttcaaaaataaattaaaagatagagatgggggtctcattatgttgtccaggttggtcttgaactactgggctcaagtgatccccctgccttggcctcccagagttttggggttacagacgtgagccaccatgctcagccagattttattttttatgcccaaaaaactcactgtcttcaaaaagtttgaggaggccgggcatggtggcccacgcctatcatcccagccctttgggaggccaaggcaggtgatcacctgaggtcaggagttcaagaccagcctggccaacatggtgaaactctgtctctactaaaaatacaaaaattagtcgggtgtggtggtggatgcctgtagtcccagctactcatgaggcaagggaatcgctggaacccgggagacggagggaggttgcagtgagcggagatggtgccactgcactccagcctgggcaacagactgagactccatctcaaaaaaaaaaaaaaaaaaaaaaaaaaaaaagcttgaggaaaacaaaatgctttggttcagccaaccttttgctgcttgaagtcagagactggagcgagaacagcctcagcagcacaaagcctgccctaagatccctgcgcctcttccttgagagggcaggccagggtgggttattgcaaagcaagggttaaaccagcttctgcaacaccaggtcctggcctggctcatgcactgtgccacctgagtgtgtgtgaggctgggatggtcatgaggcctgcctgtgtgccctgtgaaccgttggggtgggtggaggtgtgtggccagagtgaagaggttgctggccgattccactgtgaaggtcaactggggagccagtaactgtcacaaagtggaaggaagagaagacagcggaagcccagagaagcagtgtgtctcacctgcggcagcgcactttgcttggttggcttggggcagaggctgacgttgagagctgtcaagataccagttgcacatgctttccccctccacctctgtgtgcattcctccatccagagtagattctgcgcgggacctcccctctgtcacaccctgggcatgatgttgaggaagccagtgaattgggctcagccctgtccttggggagctggctattcagggtggttaccacgcacgtggctgaggggcctgacctaacgtgtgccttctgggaccctctgcatatagctcgagtgtccccagcatccttgtgagccacatgctgatgctgcagcacgccaaagccctgtccttggtgtgggattatttgcagttagtattccaaatgtcaagttccccttgacttgcgctgagcagacaaaacaaaatggcagacagattagaagaggcttgagaagccttttaggatttgaaaaccttactctgttgactttgaaaagctgctgaaccaggcccatctgtacagggcctgggggcatctgcttggagcccattggctccgtgggcttgggaggctctggacagtgctggctctcccctccccacctgcgtgtgcatgggagccagggatgctcaccgagaatgggcaggaattgaatgcagtccctcccaattagtgttgtgagggaaggagaaaaggagggaaggaggagaggcagtcgggggctggggcctctgagggcttcaggaagatttccggtgagtcccccaacgtggggggccatgttagtcagcatccatttaatcccatctcatatttgccctgcttactgcagagacccagtgggtaaaaggaaacaggatagcccactggattatagtctttctggaatggatagttagaagtttaagaagttatgcccatcagaggtacagaagtccctggctaagaatccagagtgccagtgctagaagaactttagagatggttctgtttattcccttctttctgcagatgtagtagctgaagctcagagaggttaagtaatcggtcgaagccacacaggaagcggtaaagctggaattggcgcccatctctctggctccagtgcccatgcttgtcctgtgacatcatcttggctcctgctcttaatcctcccttgcgagacttatttctcctgcccttcccccagctacttccttttcctgcctggattccccaggaattcctctgcgttgctgccttgtccagcctgggagaagcgacaagagctgaccatttgagtgagaacccagccccttgctgtttctctgacaccttccagggatcagagtgcttgtcttacgggattgtgcgtgcctccctggctcctgaggacaggcagaaatgagccttgcgcctttttgggcctctcggtctcagggaggtttccttgaatcgatgtgtttgggcaccggggagatagactttaaatgttgtgaaactctggggcccatggcagcctgtggtaagtctggccggacacatgatcttcagccctagccttaaatcagcctctgtctcctgctgtctctgccagccatgcagggcagattgcatgagggttcttgacatggatcacagttgccggggcccagagtctggaaggtggtttttgtctcttgtctcctttttctttgcacacttatgcacaagtgccttttgttcccagaaatgcagctttctcagtccccatcctagaaacattgtcggaatgtaataaatctgattctgtttatgttgaagaaatgaaacatattgctctccaaggaggaatgcagcggaggccttgaacagggctatgtttatgacaacagtttgcacatgtggctttatttttgaaagcgtagtgctttgcccttcttgatgggattctggtaacaagagctgattcttgtgtccgggtgttgggcaaacaaagggcagagctggctgaggccctcacagctgtggctgtcaccttagttctgagagcctggctcctctaggcccttgtcctttcctgggggttgcagctcttcccggggcagtgcctctgtgctgcttgagtcagagcttattagttcagcctcctattcccatttccaggtccaaaacaacaggatgaaatttaataggcataaatgtaaagtcctacaatgtgggttcaaaaaaatcaacttcacaggcacaggatgaagaagattcatttgaacggcaagtgagaaagtggcccttgaatgtagctgccagtcggctctgtgtggcagcagttggccatcactgaaagagagtaatacaggctcactgcacaggtatcatgtccgcaaggagaaagatgatgttgttattgttaataattcatcctaatagctaggtactttacatgcattattcttccattcttaaaaccatcctttgaggtaggtcatatgatcctcctattttggaagaggagaccctggcttggagaggttaagttacttgaccaatgttaaactgcaagaaagtggcgggaccaactgtaatccaggtcagactcagagcctgtgccatttggagctaatgagtgggtccgtagatggtagagatttggaatggagaaacactgaaggaaatgacagcatttagcttgctggcagagtctttataacatctgacttgtattttatttgtttatttttgaaatttatttatttatttatttattgagagggagtcttgctctgttgcccaggctggagtgcagtggcccaatctcagctcacttcaacctccgcctcccgggttcaagtgattctcctgcctcagcctcctgagtagctggaactacaggcacgcaccaccacgcccagctaatttttgtatttttagtagagacagggtttcaccatgttggccaggatggtctcaatagcttgacctcgtgatccgcccgcctcggcctcccaaagtgctgggattatgggcataagccaccacgccaggcctattttatttatttttgagagagggtcttgctctgtctcccaagctggagtgcagtggtatgattagaactcactgcagcctcaaactcctgggctcaagtgatccttccatctcagtctctgagtagcagacaacacatcaccatgcctgcctagttttaaaatactttatatagataggatcttgctttgttgcccaggctggtctcaaactcctgggctcaggtgatcctcttgcctcagctgccgtagaagctgggattacaggtgcaaggctctgtgcctggctacatttgacttttatatggccctcactgtgtaccaggcaccattctaaacagttacatgtatcacctccattattatctctgttttacagatgagaaaactgagacacagagagggtaagtcagttgcccaagatgatacagcttatacgtggcagagctgggatttaaacccagatagcctgtcttggagttctttgattttggttttgttatgtagaaacggggtctcactatgttccctcagcctcccaaagtgctgggatttacaggcgtgggccaccatgcctggcctgttgaagtttttaattaccaggccatgcagccttacggagagtcaggtgggttggggtggtgagaaatctgacggtgttttttggcaggatgatggctgtcctgtttggatccagggcagagctacagcctgagcatggctgtataaatgggagaggcatctgctctcctgactctgcacaccaaatggccaggaataggcagaggaggcgggaggatgcaggagaccatcttctctcccgagagtctatgaggttatgaaaatcctttccgtattctgtggggtatgcaaggtctccaggcacacccacgtagctggctggctcccagggctttgttgaggacaaggtcagctttcctggacattccccacccccaagcagtggtgtgttcagtggtgatggtccctgcggaccacaggaggggaagtgaccaggtgtttgccaggtccagcctggccctattaggaagccctggttgtcaagcgcagcagaactgctgacagtgacacaggggaacaatgctgcgtgggaggaggcgcacgcgtgtgtgtgtgctcgcgcgtgtgtgtgcgtgcatgtttgcttactcccctcctgacccgagtgccagcagtgacacactttacttgtcccctctggtcccctgtgggcactgaatctgactctctgatgcgcttgacgccctctcagggcccttgttgagtggcagctttggctgtgggacaagggagcaagtccgttttttttatctttctccctaagccagggcagacagagggatgccttaggcttatgtggcctttttggagctcttgtcaaggacccctgggagcgtgtcacttccttggctctggttagggagtggaggcacaggaaggtgaagtgacttcttagaggccacatagctagcaaatgtgggccaaagctatagtcaggccctagtgactggggccaggggggtttggaaagatgatctcttctgcccagccctttcatttacagatgaaacaatgcagccagatgggcagcttgacctggctgaggcattcaaggtggctgggactagactcaggtctcctggctccagatcccacatcatcctctccacactcccacccctcccagcagctccctgctccacttttagtttccttgcatctcacttactgttgctgcctctcctgcagggctgatgcgtgtatctgtgactgccatgtgggagtcctttcacctactgctcctgccaccttccttggttgccagtatctgattattctatttgccaccccccttgcctcctgggagctaatagcaacagctggaactgaggggaaggctcacaggctttggctaggcagcctggaatccactctcagcccttcacttaggagctgtgcgaccttgggcaagtccttcaacctttctgagccctggtttctcatctgggagataagatgattcggacttgataacctccagtgaccttgcagccctgcacaggtctgtggctggtgattttcatgaaagggagcaagagccacactgacctgttgttggaagctgttgggaagggcagatgacatggactggtgggaaagaccctgtgttaggaggctcaggcatgcatttccagctctgccttcaccagagaacagttgccttggctgtgggtgctggcgggcagttggggcaaggcaccaccctccttgttgcttctctgccacttcctttgcaccaatgctgggggcacagacattgctcttcctttttggtgaccatccagggtagagaagttgctggtgagtgtgtgagcagcaggcttctccagctgaccagcgtgttgcagggcaggagtgatagcccggcacaggcaaatgccaaatcctgtgtcacgtaagaggaactccagctctgttattgggcctgtgagatcctatgcacagtagatcacaggtgtggtgtggagggagaggcatcagagcagaaccagaaaactctctttgtcactgtcttcagtcttgctattgtgttggctgtatacatggttttcattcttgggtttttgtcttggctgtgaagtggcacgattttctgaactaatcctgtttcatgtaacccgaacccaagtatctggacgtgaagggcgagctttttcttcctcttccttaaccaaggatatccgagactgtagcatctggaagtggttgggcatctggtctgagggagtgtgtgtgtgcatgcacacacttctgtaatactgagtgactgtgtccagacaatgcgcctttgtctctccagccaggcatatacctgtgcttctttctatatagaggacgttacatgcggaggttattatatcggggcatatgtttatgtggcatacacatgtataaacctttatttctacttagaagaaggaaattttgaagggctttctgtgtactaaagtgtttgcaatgatggatgttgatgtatttttctttacaaaatgtaataagccatttaacagtgccttcagtggctgtcattagccatttcttcattacttccaggctctgccgaatcatgcattgggggatccctgctccctggcaccaggagcagtgatctgcacccacggtggtgtgctcaggaggtagcacggacttcagggtggcctgcgttggcgatctgttaagggtgtctctttgctgcctggttttgacgtgggtgggatcctgtcctgggagatttctgggctggttgtgtccttgagagttaggctctgaaagggatttttttttgactgcacaaggttggagcgttgagatttgggctgtgtcagcaggtagagcccgtgtcctcaccttgcaggtgacaggcagacagtgctgggtacctccatcagagggatgtgcatgaggaacctagggtgtactggtggtggggagggactcctgtgaacaaagcggtcgcccttgctctggtttgcccccagggactgctaggcggtggattcatagtagaattttacactcaatgccagaaagaacttggtatagccataaggatgaataaaatgggaatggatggccgtggaggtgtagggggccaggccaggtgactccctgggcacagtatttgctcctccctgaaccactacttgagcctctgttaagggaagccattcatgcctccctcttggtcaccagcagtcctcatgtgcccggaaccagtgccctttgggctggtcctccctccttgctggtggtaatcacgttgattgatgtttgcgtttttttcagtttggcccagatttccttctggctcaggttgattttcaggcctgccttctctgctttgggggctgcctgtgcgggggatccatgcaggtccgttttgttcttgggctcaaggctcttgtgtgtatgtattaggggaccatataatatcccaaccaggatacttttataaccaggcagtgctattcatcagtatggtggggcgccaggtgtgaacgtgcaaagtctgggatgcgtggtctccttggtgttatgttggaagctctccttccagctactgggtattgaccaaaatctacccaaaagcagtccagtgttcctctcccctccgtactccagccctagcagcccaagatgaattgtggggtgagaaggacagccaaccaggcttgtcccctcccccatttctcagggaggggagcggctgggccgctgttttgtattgaacatttgctgccatggcatccagattcccaagaagctgggggctccctgcctgtgattgtgtaacttggaacagttgatggggagggagatccctgaattagatcaggaaaatgtccttttctggtgacccttgcagagcctatagtctccttgaggcttgctcacctcccctgtagcctggggccctggaccaagcacaggcaggtggcagaggcctgacagtgggccctcttgttgttgcaagccccagcctggcaggccatcctgcctcctcccagtacacaatcagtattgattgtgcaggaggctgggactgtcacatgcagtaatccttgcttcacagcaggcatgctccttgaaggaagaaaggaagaggttttgtccctgatctaacatgcctttaaaaatgcaccttgatttaagattcagctttttgcagcatattttaaaatgtcagaaagataaatgtgcagccttcttaatgtgtctgccttgaacagccctttaaaaaaagtatatcattcatcctcagggtcacaggctgtttgcctccctccctgcctttgatggtctatccacctcttctatgagctgagtttgggtgggggcaggggaatagactcaaacccccttccttccagaagtccaggagatgcatttcttttctctgttttgaggctagtcaagaaagccatacagagtttctagaatattatttggaactttgcaaaacaggcaggatctaggtacccttcaggggcatccttctcatttcccacaaaaacccactagccagagacgaagaggaggagaatgcacacgccagcccctgccctcctggacaggcaagcactggctccccgttccaccgtcatgtggaggaagtagggcctggtgcgttcctgatgcagtgcctgtggccagagcttcatttccaaggttggggtagtggccccttctcagcttctttaaggtcccggtaggtattgggttacaggtaagggagatgccactggagagggaatcagtctgtggggttgtcattgtgtgatggctttttataaaggcgccttggcaacatggctgtagctgcttctcccagaaggaactggaggaaccccagcgtttttcaagatgtgagtgaagatgtcaaaacactgttaggctgattcaggaactcagaaactctggtggacaaggcagcatggagcctgagcgagagctgctgggattgctggtgtgatgaggcagtcacacatggtgaggcctgggctagcctctgcaagtatgtagacaaggacctggaggcccagagagggtggtgacttggccaaggtcacacagcagatcagcagtagagccaggaccagagccctgccaggtagttcttctgaccagaagcttttggtcacctcagcctcctgcctcaggtgggtcgtgctggcgactcagcagtcctgatttcagcacatgaacacctcgctcaggcagggtcgtgcgtgtgttccttgttgtgaacacactggacgatgtggtccttgcctctgactcattgttcgctgcgggccctgttgcttgcaaggagagaggatgggagatgaggagtgccgccctgcatgtgatctgcctgggtacgaggtcaagacggctgtggagtgactccagggtacaagccctcattctccctcccactccctagagtcgcccgtcctcttccctatcaaccattttgaggatcataacatttatcatgagctttattatgggagactcttcttcgtgtttaaaaataaacgctggcttacggaactatatttggtatatggaagtcgtttgcatgtaaatgtgcttaaaggacaactgctttatttaagatgcagagtgagccccagctagagcgtgcctgggatgggggaggggacaggacccaggggtctgcctggctctggacagatgagtgtagcccacagtcctgttgaatctgttgtccttttccctggggacagttgcagaacaggataactcgtacttaaaaattcatagaaaatgtttcttattataacgtcataattgttatgactcagaaaagtagaattgcctttccactatgcctgtctgccctcacttttgttgcctaccgagtccccagcagcagctgcagaatcattaaaaaagagagagagaaagggaaagaaagaaagaaatccagggcgatgctttatttatgttaacggctacatttgacttgaaaattctgtcccctgagccttgaggtcagcacattacagagtgattgatggctgtcaggagcaggcagggcggcagattgcagagggggaagtggacagatgatgccatggctttcccggggcttagcagatcccaggccttgaaaggaacgtgatggaaaacaaaagcagatggagaactctgccttggcccttacctgtttttttggggggttttttgttgttgttcttgttgttgttttccttccttccttccttccttccttccttccttccttccttccttccttccttttccctctctttcctgttgagcattaggaagcgggagaagggcattctgcaccctcagagcaccccagaatgtgtcacttttgggtgtggcactggggtaagatcctagagaggctgggcccaagatgaggcacccctaatcccaagtgcctgagttactgcttagaaaccaggaggcccggctctgccctggcgttgcctgtccttgaaatccccagaaacatcttgggcaccccccacccaccaccaccaccaccttctccttggccccgtttcctaggtccacaaaccaaacaggaggaccaactctgggctcttgtaaattgttcctgccttatggcctgcgctacttaggattatgtttccacagggctttctggctaatccttgtgtattttcagtggtggaaacaaatggtatcagacccacaggcctgtttacagatggggagacacggaaatgatggaagagctttgaattttaaacattagctaatgaaattgcagacaagggcaatgggtggaacggcctgggtattcccatgaaacagttattagagtcagaatgctctggggtcggccatgagggagaaaggcaggcctggctcgcgtgtgtgtgccacaaacatttatggagccctttcccagtgccaggagctgcgtcaaggaagagctttgagtcctgcccagggtgtcccagcctggtggctaaatagaataagcttggggcagagaagcagcttgactggcaggacctttctgcacagaggagctggtatctgcagagttggaggagataccaaaccaggcttggaaggaaaaggaggctgacctggctgcaaagaggaagggatgcgggagggtattccgggcagatgctggagaagctggaggtgaggctggagttccggtgtcccccggaatgggcatgacggtgggggctggaattcgtcatttcccctgcttctgcctccccctcttgttgctgcgccttgtgcagttgtgtcagagatgggactggctgttcattcatccgctaattgttttgataagagactctaattacccactgcgatcatcagattaccctgagctccaggagggagatttgagagtttgagctgcggctgctgctgccatcagcaccgccatccctgctaaaaggaacctgctcctatacctcggcccctgtgcctgcctctggccggtgctcactaagccatcacatgaaggtgtgacaggctgctgggtggggggtggcgggggggagctgcctgtgaaatccacccgagagtacaatcccctgatgtcaagcaggattttccctttgattatctttgccactgtgttaagtccgcagataagaggtttggttctagggatttcaaaataaggagaggagtgtggaggaaaccagagaaaaacagtagcgcctctaatgaattgacatcggcagtcgagacaaattcaaaatccttttcgaactgtttgattaagttctacttacatgtgattttagtataaagagagcaataggcaaaaaaacaaccaggaaggcagattataaattaatccaataattgaatcccccagcaaaggtaatggggaatgatggtgtcgtaatctgatacagaattttacatcagcaggagttacaaaataagggagtatttcatcttgggagggctgattgtgattggatgtattgcatcttaaagccttggcccttggaaagctttggtatggcatgtctgacctttttcccaccttccactcctgtcttcattcattcagccacgtctgtagatccagaagagctggtgaatcccatgatgcttgggcctagagaagtaagattctgttcctgccttttcctagtgagatcagaggctcacaaatcatcttgttggttaacatggttctcagagaaaggggcagctaggctgtggggtctggctgggatttagaggagtgggcagaaatggagctacaataccgaaaggcactgggcgctcagtgctggagtgactcgtgctgggatgaggtcctgggcccagatgctcggctgctccatttttccgtttataaaatggaactgcagtagatgatatcaaagttcccttttggctctactctcttagtttgtttattcttagaccccattctcccgccaaagcagaaagccagagaacataggtccagctctctgctccccagtgctggctgctgcaggctgtgccttctcctcttggtagagcagagcggctttctgcctggctccctcccattgtcttcacatttggggctcagctagccgggaagtttggcaacatgtcaggccgtgtatcttgaaaaccaccctccagaaaccacctcgtttagcagatttaccgacatattggacctgcctgttctcaggggccagcgtactaaatcacagcggggccactggatgccttgacgcagaacttttcaaaaaatttcaagcaggatatatcaccaccccattaactccctgccattaatctactcctaaaaacctggagttttcccaaaaggaactggaacggggtgaaaaacggacccatttggtaaattctgtaaatcaggctggccttctctcctcggcctctccagccttggtgatgggttgctgcgtgggagggtagatctgcagccttccaggctttcgagggagtgtccccaggatggatgtcagtcttaaggggctgctgtactttatcctgctctggcctatggggtcactgagtgaagtgttctgtaggggtgtgggggtggggactgtcgtcaggaagagctgcagagaatgcagccggcttctcgatggcacagaagccgagcctcatgctggggctgtgccaaggactgtctggaagggaccaaccccttgcctgacttttctgattgccaagagggattttgttgtaaaggggctttgtctgcagccctgaagactgtcgaaagagtccatccccacttctgatttctgtggccggaaggctttctccttttggaagaagatcctgtccaggagctggttggagcctgacaaacctgggtttgaaatgccagcattccttgctcactaacctcaggaacgcaggcaacacgcttaacctctgggctccttaattccgcacctataaaatggggataaaacacattcttcaaggatgcttgaggattaaatgagataattcttgtaaaatgcttaggataatacttagtgcgatgctggcattctataaatgatactcagttaatcttctctggggggacacataggatacctgctgcattctgcttgtacatcctgctcaggtgggcctgtgctagcttgaaaaaggaagaccgtcttttttgctagttcctatctccctctaccacaacccagtctttgcagcctcacttttgggttagagtcagacagtctctggggcagagccttcctctgctccttctgggtcagtcctttccacctccagataggtgggaattcagctgtcattggaatccaggcttttgcaatccaaggctgagctttgcccccaagcacccgcatccacccacacatctgctggccttctctcggcccttccttcacttgcctgaaggcagatagcgtggtgaggtgaggccaagagcagtccttacctgcctgttgggacagggtctgatgagcaggccaggacaggaggctggagcaacacctcctcccaggaagatggggagcctccttccagcaggacgcctggcgtcctgccctgctggaggaactggtttccagggcctgactcccagccccacctgctggaggggtcttgggattcgagaggcctgagagcagagatcttgcctctgtttcctggagtagtttacttttctccccacttatggtaaaagtatctgttatcttgtgcatcttctggcctttacaacactgattaagccctggaagcagaatttgggggcttaaattttttttctttccccactgaagagtagtcaaatgctctgggagcttcattgacttgcttaagggctgtccattggttctgtgagctgggaagtgggagattgaagggccctgtacctctcctcaccccaggaagttccaaataactcaaaaaggttcttctgccttgtctttgttctggaagtttggagtctcctcctgagttcccttgaaaatcataggtcagagttcagtgaacgaaacccatggagtacgagttattatttgtcagttttgtcctgggacaattacggctttttattcccagcccccctgtaagtgcctggggcagtttgagggcaaccagtgattgtatgggttcctgttttatgttgggtgctgtgttgggactttcaaaggccacctggtaatgccagctgacttaacacctgacgcataagtggatggatggttttgcttgaacctaggttggttggttgaggtgccggggttggggggtagggagacaggtgagttgttgcttggagaggagagagtgggtattccctttttttttttccttttcttttgtccttcctgcaggggaggatcttgcttcctacatctctttagcatacataatgtagatcccatgttcctgcttgactttgggcattttcacatggtatttgataggtgtcatcttgagtttatgtggccaggtgcattatcagatgtggcagtaagaatgagctatatcctagatcccggaggggattgcctcctggcccaagaactcccaaaaagttctgatgtgtggtgggcacacatcagagaaggctagccattgtctgtgctggtggctattggccatggctgttcacctctcctgcacctcaacccactgaagcctctgcttccccgtgctacaaaacttcaccagcagtgctgcgatgaatctctgatgcctcaaatccacaggtgtctttagtccttgtcagccctgtttactgcctgattctgtgtcttcctttctcctgcctggtcagcctgtcccagcagccaggaagggacaagagaaattgtggagacttgtgagaagccagatccttcttgtacagtggtgtcataaatgacatggaaaggctggaagcggggccaccactgtgcccctcccacttcccacctgcagcctttgaggtctggtagacctattcattttccagtcctgaagctttggaagggcagggttgagcagagtgcatcctattttccagcccttcttccaaccagctttcagtttttatctccaggcaatcaagcagtactcaaaacatcatgcctctactcatgctcactgaacctccttactttgtaggccagtgggctgagaccccacctccttctcatgggggacattctatcttgagcctggtcgacttcagctcccttttcctcattctgctcttaatttccagaatagcacatggaagacactccagtatgtttgcgtgagtgatgctagtcggttgtcctttgagggcttaccatctgcaagtcagtgagctgaagctgtgcgtgcattcttcgtttgacttgcacgggaactctaggtttcatatcgatttcccagttttccatggagaaaaccgaagtgcagtcaggttaaggccttcccaggcctctggcctgagagttgccctacttgtttgtgcagactcacctagaagagcctttgttgcgtttgtggaatattgaggtaatgcagtgagagctttcgggatggtagcagggtgtggtaaaaggagccctgggacagaagctagggatggataccacccagccacttgacctcgggcaaatgacagccccactcaagtccacagtttcttcatccagaaactgagggcactgagatgaatacagcctgctgccagagttctctctctgaaacacatctggccacgctgcaccagtgcctgcagtcttgagggcattctcctgttcttcagggtgaagcccgagttccctggctgggcccccaaggccctgtgggtcaacgcctttgtcacagcatctcctgtctctccagggtcagtgcctttgtcacagcatcctctgtctctccagcatgaacagaagggcttcttgggagttcttggctataccatgttcccttaggccactgtgcctttgcctgtgcattttcttctgcctgacatgccccttgctgcttttgcttgctagggggcaagcttccccttgcaactgagctccaggttattttcccagcaaagctttcctgcctcccagagcggaataaactacaccctttttttgtactcttgttcattcattccacaaattcattggttgaatgcgtaccgtatgccaggcactgttctagttgctgcagtttccgagaaagccccagaagcttccgtgtgtggattgaagctatctgcttatctgctctccttctctttctcctggtttccttgaagtcaaggcctgtgcctctgtgtctgcccccagttcctagcacctggatgatgttcagcagctacttcctgacctccttcccacctctcaggactctggcattaacttaaaacttttctggtgggcgagcagtggctcacacctattgtaatcccagcactttgggaggctgaggtgggcggatcacgaggtcaggagatcaagaccatccttgctaacacggtgaaaacctgtatctactaaaaatacaaaaaaaattagccagcatggtggcgggcacctgtagtcccatctactcgggaggctgagggaggagaattgcttgaacccaggaggcggaggttgcaaagagccaagatcgcgtcattgcactccagacagagtaagactctgtctcaaaaacaaaacaaaacaaaaaaacctttttggtataatctgcctttgcctgtctttggcttctttgaagccagatgtcttccctctgtggtccatttctttttttgaaaaaggccagtgtcaccccatttctcatctctgaaactggcttccctttcacttttgttcagtgcttttccaccctggaagtcactggcatttgactcttctgctagattggaagtccctagagggcagggaggcctctgattcacctctgaagattcacctccctctccagcctggcatgaagcaggtacctgggacaggaatggatggcaagctgcctcctgttggtgcatttcagaggggtctggacactgagggagccttccttctgtcaaatcttgaaaaatcgtgaagtctgtctagacagtgagtttgaagccagtttctccagcattagtctttgtggttgcttcattcctcagatgcttcccaggccacctgcgtccttcaaagagaagaggccaacaaaagaataatacaaattttctggaaataccatgtcttagctgctgctttttcttcaggacttttttttttctttaaacctaataaattgatgcagaacctgcctctggccatttttcctgcaggtggtcattgtccccttggaaggctcgcgccagcctggaaggttgatcattaacaaattcagggagggtctgtgtggtacaagcaggagcacagaaagttggcttgcgtggaggtaggggatgctgaggaccttcccacctgtggggctgaaagtgacactgagtgggtaaggctgagtcctgaggctcctgctgcttctgtgtttggaaatttcccttataaaggggtttctgcttcccgtccttcccccagcacaggcagatgtcttatgtacctacatagtgccaggtgtagacctggatgggagttgcagagcgggtcactctgcaactcccattcacgtctacattgtcagaggagctttccatttaatggtgagggtggggagaaggtgaccgtcactgtgcaaggggacatgggccctagctcttaagtctatctggctcatcatttagaagctgtttgagaaggatgttagctcttcgctgagcctcagttttctcatctgtaggctgcggataaggatacttcctcacttctctaggttattagaaggattagaaagaacacatgtagaagcacctgcaggtccccagtgctcagggctggttggttctttgcccttctactccattgagcgtggtctgctgcagctggtgtggtgtggacagcctagaacactaaggattcggccaaagaattgcagtgtttccaagcctcaattcgctcatccatagaatgggaattgccattcactgggttgctgcgggggatagatgaaatcatagcagggaaaggtgccggatacatcctgggaaaggacgaccccttccctcctgttactctctcactaagttttaaggatattgtaactggcataggtaaggctggtacagtgatataatagtctggaatatctttgtagtgggaggagggggaagattcccggcttggggtgggggatgtggagaggctcctgagaggtgatgccacttcctgcatctgaaggggacctgggagagcaggctatggacacattcctctcctggcagtcctgttccttacagcctgtgcctccagctcctccaccaggaggtgagactcggcagagagctgcttggaaagctttatcctcccccagccccccaaactctggggtgtgaagatgaactggtgtaactatagcttggtgttttggtgtctgtgaggaaagcagaattggctcaagctgctttctcagttaaggggatttaagaagaaaaaaaaaacttaatcctaccctggtgatcaatctgacaccttccctttgagccccagatggctggttggggtagaaagttggccactgctgctgttagggaacggaatggtatagctgtatctctatattgaaaattatggctctctgtacgcacatgcacattgcatatataaagcctgcatgcctggtttggttttttggagggtattgaaatactcccagaaggttcctgttggttaaatgtcatccttggaggtgtcatgtgaacactacctggaaccatgttcatttgccttggttcaaagtctttacccacctctcctcgctcccaccccaagcctggagatgaggtagatggcatagaaagaggatggagaggccgggcgcagtggctcacgcctttaatcccaccaatttgggaggccaaagcaggtggatcacctgaggtcaggagttcgagaccagtctggccaacatggtgaaaccctgtctctactaaaaatacaaaaaaattagccaggcgtggtggcaggcagctgtaatcccagctactcaggaggctgaggcaggagaatcactcgaacccaggaggtggagattgcagtgagccaaaatcgcaccattgcactccagcctgggtgacaagaacaagatttcatcttaaaaaaacaaaaacaaacaaaaacacagaggatggagacatgacctcactgtcttccctccttgagtacagcaccccatctcttgtagacaactttggacacgttttggaaagtgaaagggaaacatttactattatcctgagtgacttctagacttggaaaaaaggctgcccaggtctacacatttttttgtggtttgatgcttttttgtttgataaacatgtttatcaaattatgattttttttttttgagagtctcgctctatcacccaggctggagtgcagtggtgcaacctctgctcactgcaacctctgcctcttgggctcaggtgatcctcccacctcagcctccccagtagctgggatcacaggcgcctgccaccacacccggctcatttttgtattttttgtagagacaagttttcactgtgttgcccagactggtctcaaactcctgtgctcaagcgatctgcccgccttggcctccaaagtgctgagatgacaggtgtgagtcaccacggttggccgatgctttttcttttgataaatagtatattatcattacagtttaatggcctcatatgctttattgaatcattcccttaattggcgattccttcctgtcctccatctctccaccctgccattgtacataacactgcagtgaacatctttgccttccattgtggatgatttttgctgtgatctgaatactgagtctccccaaaattcacattgttgaagcataattttcagtgtgatagtagtgaaaggtgggtcgtttggggaatgtgattaggtcatgagggctccatcgtcatgaatggaatgagtgccctcctaaaagaggctgaagggatgccgtgtgaggatgcagcaagaaggtgccatttttgaagcagagctcaagccctcaccagacaccaaatttgcgagtgccttgatctcagacttccccagctctggaactgtgagcaatacatttctattatttataaagtacccacgcgaaggtattttcttatagtagcaagaacagactaagacatttttattttattttattttattttatttatttatttatttatttatttatttatttatttatttatttattttattttttttttttgagacggagtctcgctctgtcgcccaggtgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcctatttatttatttttgagacagagtctcgctctgtcgtccaggctggagtgcggtggcgcgatcttggctcactgcaagctccacttcccgagttcataccatcctcctccctcagcctcccgagctgggaccacaggtgcctgccaccacacccagctgattttttgtatttttaatagagttggggtttcactgtgtgctagccaggatggtcttgatcttctgaccttgtgatcttcccgcctcagcctcccaaagtgctgggattacaggcgtgagccaccgcgcccagttagaataaattcccagaagtgcaattactgggtcagaaaataaggaccctcctgctaaaacccttgaatcctttgccaaattattttcgggagggttgtcttggccaggtgcaatggctcatgcctgtaatcccagtactttgggaggctgaggcaggaggattccttgagaccaggagtccgagaccaatctgggcaatatggcgcgaccctgtctctaccaaagaaaaaaaaatcagctgggcatagtagcgtgagcctgtagtctcagctactcaggaggcagaggcaggaggattgcttgagcttgggggtttgaggctgcagtgagctgtgattgtggaactgcagcccagcctgggtgacagagcaagagaccctgtctttagaaaaattaaagacagagatcacactactgtactccagcctgggcgatagagcaagaccttttttttttttttttaaattaaaaaaaagttgtcttaatttatactgaggctagcaatagataaatgggtactctaactgcattttaacttgcactggaagttattaaacattgaagaatctctttttttgcttgctctagatgaaaaatgttataactccgacttttctactttctgtaccaaacaccaagtccatctgctgtgtgcttctcatagtaccaagtggtgtgtggtgagttctttcttttccttgactgccagggacttgcagctatgtaagagaggagggacaggcggcggctggaaacagaggtagaccaggcatggtcttgtgctattgtgtgcagttatgagctgcaggctgtctcacaagttaaggagagagagttatgtggcccagagagccttggccttgaggaatgggtacagacagtgcttgatctgtacagggaggctccggtagtagccttgattcaacattttgttcagtaatgtttatgggggcctcctgggcaccaagctcagtgggaatagggagatggataagagccagcagcctctccaggcagacagaatcacacgcggggaatttctatatgctgtgacagatggctggatagggtgccatggatgatcagggccgagtgacaagctctgccgttcttttgttcttaggattttcagctcccttccccctttcctgcttatcaaggaaggttggccagatcaacaagtatcccctccctgtccagcgtctgtacccaggtggctttgacttcatactgggaggggacactggaagcctcctcattcacctcctttgctgggacactgccagttgaccgggtgctcactgtcttaactaggcagctcactctccaattctggtgagaccagttccacaaaaagaacaactcttttccttaagagccctttgaggtcccttttaggcaggatctaaggaaatatttaagttcatagaatctttgtctagggaagcatgttcaaggtatcagacccaactaactgctcatccatttaacagtctatttcacaaatctttttaaagaaaatgttgaggctttgtgagtgccaggtagggagcttttgctgtccccaccaatgttggtgaaactgcactagccaggtgtaggcacaactgcaggccacagcctttggtgacatgtgtgatataaaagggttgctgtgcccttcttctggatctcacagctctgtgaagtggaggagtccttcgccctttttgcttccctctggagtttgcgctacatggtaggtcctcagaactgcttatttgaatgtgtgcccgcatacacttccttggtgtgtcttgtcagtatgtggtcttcctcccctacccctgccagacaatcaggtaatcctgtctccccttggagactgggtctacgttttaccttgggtgctggccccaactctgctccttagtaactgtttggctaagccccccttggctggctcccattttccatctcagccactctgatacctcatagatctgaaaagtgaaaatctggctgggagcagtggctcatgcctgtaatcccagcactttgggaggccgaggcgggtggatcacctgatgtcaggactttgagaccagcctggataacatggtgaaaccccgtctctactaaaaatacaaaaattagccaggtgtggtgggcacctgcaatcccagctacttgggagactgaggcaggagaatcgcttgaacctgggaggcggaggttgcagtgagctgagatcccaccactgcactccagcctgggcgacagagtgagactcttgtctcaaaaaaaaaaaaagtaaaaatcctagtctccctccttaccagctgccctaatatttgggaaagcttagctatcttgactctgagtagcatctgcttacgagcactgcacagaagtgatgggcagcctacggctgcagggcaggaacactccaggcccccgtgcttttgtgcaagaccttaggcattgaccccagagtacttgactgttgatgtcaaaaagcataggcatagctactcgggaggctgaggtgggaagattgtttgagcccaggagttttaacccagcctcggcaacatagtgagaccccagctctttaaaaagaaaaaaaaaaaaaaaaaaaaaaaaaagcacaggcacacagcttcggtgtgagcccccctagttcctggctgaggagcagggaagccttgagacagaagagaaagcaggagccctagactgtatcagaaagaagggttatagactgtgctcccagctgccttccattgtctggcgaggcagaggctgcagccccctcccccaggttcttctttggagaacaaacatatcaacaggattgattaccccgattggtccctgggcagctgtctctggcctgcatctggagctgatttctctgccgttgtacacccattgtcttggattgttcacttctacaaatcagagctggctccaccgccctaaccctagcacgaccccagatgcttgtttgtcggtggaatgaacacttcctgctcaatggaaaaaaaaaaaaaaaaaaaagctccaggcacacgtgggcaggctcagggccacctcccctgctctgatgcagacaggatgttccttcccatcccaccccctcctggcctccctcctgggcctgcctttctgaagtggattcaaagtggaagagacatttccaggaagctggaccaatcaacccccactggagggggagctcagaggggagagacacccaaaggctgcagtatggcactgtgctgtgggctctggctcccaggtgggacccaagcttgtgaggcctggtagccccctgacatggctgtggtggtcttgtctgaacactggcctcaggacttgtgacatcagaatgggtgggagccttaaggatacagagaggggtcatctctttcctttgggcccatagtagaggctgtgaaggaaggagtgtacaggacatgttctctggtcctctatgtaatcctgcaaatttttttttttttaagtgcagtggcgtgatttcagctcactgcaacctctgcctcccgggttcaagcagttcttctgcctcagcctcccaagtagctgggattacaggcacccgccaccacacccggctaatttatatttttaatagagacgaggtttcaccatgttggccaggctggtctcgaactcctgacctgaggtgatccacccacctcagcctcccaaagtgctgggattacaggtgtgagccaccttgtccggcctcttttttttttttttaaagagagagtatctcaccctgtcacctaggctggagtgcagtggtgcgatccatatctcactgtaacctcaaactcctgacctccactgatcccccgcctcccaaagcactgggattacaggcatgagccattgtgcctggccactgcatattctttaacacacatcccaagctgcaccctccttgagaagggaagccctctttggccacttgcccccagcaagactttcttttgaaatactacagagctcagagctggtgctatgtgctggagccccttttctgtggaggcaaatcagccggtggatgctggagagaggcagtcttgggtttaggcttagatggatctgagagtctccccagctgtgagtgcgctgggcaggggccttggctgctgtagatggtcaaggagtccccagaactgtggctccggggaacaacacagagcttgctttgggtagagtcatacaaggactatttctacatgccacctccttgcttttttatagtgatgatggtttggctcattctccagccaaaaaccttagaaattggagactctgactcggcacgggtgcagggtaggacaggagggctgctgctcagtgtggtcaggctgccctcctgagtctgccgcccctccgagtgacggtggtgatgctgcagctatgggtgtcttacccttgggggctgtggggctggctcacatgctctcaatgggccccatgaggtaggcagggttgtctcgattttgacatcttgtgggtaggtcctttaatagtttttcaagctcttttacctccattgtccctggaggagcctcacgacaggtcctgcaagtcaggcaggcagggtgattgtcttcactttgcctggaaagtttcccagggcctgggggcccagtagggcttggacccactttgacatgacagaccctccacactgctgcctctctccttcttggcttctgttccgaagcagggaacactccatctcagcccttcctatggtgttctcagcagttggtgcattaagtcagggaggaccctggtcttcactggtggtggatttccgtcttgagcccagaggctgcccagcgccagaccttccctctgctgcccccttctgggatggccagttctctccccatgatgtgtcccccaccttgttttcccatcaaagaatcggctctggtcagcaggctaaagaagtcagccatcgattagggtccgcgaaatagacccaagcatgtgtggcttggaagacatcaagccacagatttcttattgcccaagagttctagagagattgtgggtggggacctgcggtccttccaggtgatgtcagcccccacacggagacccagacccaaaagcattcatgctcaccactgccaatctgcatgctcccagtgagtcagctcagctccctcactgcataaagcgggggtggttctccccccatcctcacaggtggtataggtatttcagttgtttgaaaagaccagcaagtggaaatactgtacttgaatctgtaaaatagtggtgagtggaagcacagagttggaactctctaggcccacccacccagccccactattccacttagctcttgctcttgccctggtctgggctggtgctttgcagattgcatcagggagccacttaccccaattaaaactgtgagggtgggggagggaggaagtgggttggggtgtgttgggaatggtttagctaatgcaggtagtgctttttaaaaggcgggtagaaaactttcttctctttgtagctcaattaaaaacccttcttaaaattaacccctgggaaggtgtgtccgtgggctctcttttcttatgtgtacccaactctgcattttcccccagcccaccccccagtagaaaaaccatgctctcaatgcctttagaaatctctatggaaggtgaccaggtgttttttaaaagagctctcctcctgtgaaaaatgctaggtagtgacggagcctgcggcccctggggagagagaagaaagcctggctgagagttgaagaatcatcccagagagggtgttgaggttggctgcgcctccccgaggtccacacggcctgctggcagcagcaggcactaagacgggcatcttgtcagccgggcagatggtgttcacctgctcgggacatgctccctggtgctggggcccttggagttgctgggataataacagacagctgccagctctggaccgagatctgcgggtattcaaaggcttggaagtgtgcagggagaaggagcctgcccgggcttccctacatgctgtgtctcgccttttgttttgagatttgtgctccccccaccccttcccgcaccaacatccgagcaacaagagcattttaatagaggacagttctgttttggaaacgacaagaaagcgccttgtcgagtgtgacctggcctcttctttgtcctgccttcccccgctttgtgtgtgcctgcaatgggttttgttccaaggggcaaaggagttggacatggatttggtgtgttcctggggttttctttcttttcccttttttggcagcagctaaagcttttggttatttctgagtacagggcaaccggggagttagggatttttcaggaccaaactccagggtctttgagttaccaagtggtgtcaggaacaagtgagtggcacagaagccaactttctgactgcctggcgttgtctaagctcattgactgtgtgcaaaggacaaatgatttctcacggtgcagtctgccttgaatcctaaggggaatgtttccctagatatcagtccaaagcaaggctggctgtttgagaaccagcttcatttccctttgctgcgcagagaagggatgccgatgttgtcttggttatcctgttactgcagcttgactaaaaacttcactcgccaatgtcaacttgggctggcccgactcagtatcatcagctctcattaggctacttggaaaacttgtgtgttttttgggggtggctcagtttgaaatttataactggcctcagggcagggctcatgcctcagtccttcagtccaagaccagagggcaggtttgtcaagcaaatgagtggtgttaataagatgtgggaaggttacaaaacctgcttgataatcttaaactgcctgaaattggtgtgttccgtttgcttgtccgcatgggatgcaccagtgacagatgaccccattgagtctctaaagctgtatgcacatatgccccagttcatcagatgagcattatgattttgttgcagtgttaaggtagaccatctttttgtctcttgtccctgattattctaaatcagtgagatttttctgcagagattgcctttttcttaggtatttttttttttgcaggggaggtggggtcactgacttgaagctcaggtattcttaaagagtcctagttttcagagctaaccttggaaaaatctctgctttccttggtgatcaatggcttatcctattcttcttcttcttcttctttttttttgagactgagtctcgctctgtcacccaggctgaagtgcagtggtgcagtcttggcttactgcagcctctgccttctgggttcgagtgattctcctgcctcagcctcctgtgtgacagggattacaggtgtgcgccaccacgcccggctaattttttttttttttttttgagatggagtctcgctctgtcggccaggctggagtgcagtggcgcaatcttggctcactgcaagctccgcctcccgggttcacgccattctcctgcctcagcctcctaagtagctgagattacaggtacccgccaccgcgcctggctaattttttgtatttttagtagagacggggtttcaccatgttagccaggatggtctcgatctcctgacctcatgatccacccaccttggcctcccaaagtgctgggattacaggcatgagccaccgtgcccggccacgcccggctaatttttgtatttttagtagagacgggatttcaccatgttggccaggctggtctcaaactccagctgacctcaagtgatctgcctgcctctgcctcccaaagtgctggaactacagatgtcagcacccggcctcttctttgttattttaattattgaagagcatctctggtaaggggtttggaggttgtttcaggggaagttgtgctttaaaacatgacttaatggattctataagcactagggatgttacaggaaaggggtcccaatccagaccccaagagagggttcttggatctcgcacaagaaagaattcagggcgagttcacagtacaaagtaaaagcaagtttattaagaaagtaaaggaataaaagaatggttactctatagacagagcagccccgagggctgctgattgctcatttttatggttatttcttgatcatctgctaaataaggggtgggttattcatgcctcccctttttagaccatatagggtaacttgctgacgttgccattgcatttgtaaactgtcacggcgcaggtgggagtgtagcagtgaggacgaccagaggtcactcttgtcgccatcttggttttggtaggttttggccggcttctttactgcaacctattttatcagcaaagtctttatgacctgtattttgtgctgacctcctgtctcatcctgtgacttagaatgcagctcagtaggtttcagcctcatcttacccagctccttttcaagatggagttgctctggttcacacacccctgacggatatgaagatcaattaagacaaggtccctgccctcaaggagcccaagtctagtagagccagaggaagtgttaaacacagcatagtaagggagtgtagattctgtgctgggcccagaccagcattaagtcctggcccgggctaggggagacagggagaggttggttctccctggatcagggggtgcctgggagtggatgtaaaggttgatagagaaggtgacctggagctgttttgggagtagagagtagagcgggtgtttgctggaggaccatagtgtaagatgatgggaccatagtgggggcgtgaccatagtgggggtgtggccataactgggggcagctggttcctttagaggaggccctgggccctgggctctagggccggaaggcagaagaagtagagggagcacagtctgactgagtaatgggattttagggtgcccaggtagtagggccttggtgatgtgttgaggcctggccttcctcctggaggctgtgggcagggaacagctggaatgctgcttgagtcttcatagtttggcctttagaatctcaaggttgaaagtcaaggtaagcagtagttggagggtcctggtggaaagttgtagtaaaaagagcctcgtgttaggcgcatgccacctctgtccactacctcaggtgatcctgggcagtctagcctcagtttcctgctctgtgaagtgcttttttatttaaaaaaatttttttattgtggagatcaggtctcgctatgttgcccaggttcgtttcgaactcctggaattatacgtgtgtgccactaggcctggcctgtgaggtggtttttatatttatatcttggggttggtataaaggtagattaagagaggcaatcacacgaagcgctcagcacacagaaataccaaaaaatgtttagtattattatcttctttctaatgataataccagtggcagctcctaagaaatgcagggtcctggccctggtgtacccagctagtggctttcccactcagccaagggatgaccgaggtaagagttgaagatggcctcaggtgaggctgcagtgtggccgggctttttacttctgttgcacagtctggtttcagataacccagtctttgccagtaatgagcctggtgtcctggactgaaactgtactcctgtttggacttgtagctgtcccctgttctccaatggatgtgttttttgacacacggctgacaccagcctggggcttatcacaccaagctgtgcgttatcatattcctctcattctttcacttagcaagtgtgtaatatccactcactccttgggagggacccagtgcgttctgtgctgtgctgccggcaagactggatcctgggggataggggatagtaggggtgcttacagtccaggaggaggaataagaaatgaacccaggagctgccagtctggctagaagtgtgcaaggagttggggataggatgggagagggagaaccttcagctgggggaagtctgggaagggctaccgaggaatgtggtgtttcccctggaccctcaaagttagtagtacttttacaaatgaggactggggaagggtatcatggtagaagacaacatcataggaaacagcttgcagataagagtgactgggcttggggtgaaactgacagcagggagagacggctgctagatagaaagcaagataatagtgaccatctttgagccccaaatccaagcgagagtttctttccacctatggcgtgtcttttataataaatccaaactcagccggacgcagtggctcactcctgtaatcctagcactttgggaggccaaggtgggaggatcacatgagctcagaagtaccagcctgggcaacataatgagacctcgtctctctctctctctctttttttttttttttaaagaaaaataactaaatgatggcatccaaactcaagttccctggcttctccatagctcccaattgcccagtctggcaaaggaagccagtggcctggagcctgaaactttcttccattttgaaaatgttccctggctctgtgattgctcagttaggtgaactttctgctctcctaaactccaactccagccatagatggatctaagttggtatttcctcagctgtgatgtctcatcatagaaaatggtgctatttatcgaaaccctaccatgtgctggccggtgtgctaggcaggtgctgtgaaaagggaaaggaggcatttggaggaccagtgatattgggaagggcagggcctgggtctgtgctgagaaactcacagctactgaatgtctttattcctcgtcataggccctgggcagtaaagggtggtggtttccatcttacttagttaagaaagagcccagagttgctcagctagcgatggcaaagctgaagttagttacccctggcctggcctcccacgccacgcctcccgccaggcatacatggtctctgctcggcctttctctggttatggtaaatctcagctggcgtggaggacagcctcagccatgctggtggagtgcacatgctccactaagagccgctccgggtcccacgcatcctcgcttcctcatggtgtcggtgggggtggtggtggtggtcttccaggctctgagaatgtgtttctctgtttatctgtgattgccttctcagcagctaccctgcgtaggccaactcatctcagcagaggacagctgagaggctttttacaaggccctgggttgtttccactggtgaggcacctgtctgttctctgacagcatccacaaactcaaccctcagccttgcaccagcagtgttccttgtctagcaaaacattctggggtctggctccagtgaccccgctggactgtgctttgttcctcctctgcctgtggctgtccttttaccacctgctccccatgcagcctttgcaggaactggaccttctgccagagttatctgttcttccacactccagcctgctgtgtccttttcccaccatcacctgcaactccctactcagcctcacctggcttctcttccctggggagccccttcactcctgctgcgtgcagctagccctgtgcccagaagacgccctggtccttggaggagagcccccctccccacccccatccccccaagagctctttaattcaggaaattgaggcattgttgtcatgttctggaaggacactaggtgactggttccaggccactgttgtctcatggaggcatcattcccagctcccttttcagcatggtaaacagcctcgccgcctgttcacattgccaaagactctaggtcgaaggctgccctgctgtcctcatcctgtgtcgtttggttccaacatgcccgacccaagtgctccccagttgtgttcagaactcgtcatggctcccttgtcctgcacaggctcaggagtaccccctttgccacatcttggttcaagtttccccttgtctgaaacttgacaagggccaccttctccggtctcctgtcctctgtctccgtgctacccatcattcgttctgcaaacacgtggaggcagtgctgtgtggagcagcgctgtctggtagaaatgtactgagggccttgcaggttatttcagagctccttgtagccacataacaaagtaaaaagaaataggcgaaattagttacagtaatatactttaattatgaccaaatatattcaaaatagcactgtaagatgtcatcagtgtaaaaatcattaatgacatcttttatatttttttcccccaaactgcctttgcagtctggtacgtattttatgcttatggtgcgtctctgaaccgcccacatttcaagtacttggtagctgcttgtggctagggcttccatgcaggaccgtgtgagtgtaaagatttaagagcacgagatttgtagcatggtggacctgtttaatgcagtttcttgactgctgtttatgggcattgtggccttgggtgggtgacttccccctccgagcttatgtgcacctcatagagttgtcgtcaggattgaacgggatgagtgcaaggaagggctcagcatggaacccagtgcatagtgaggggaaatgcgggtgattgtttacattgaagtaatgagccagaggctggcttggtgccagggcctgccccctgccccctgggctgactgtctaggcggggttgataacaaactgcccgaacaagggcagcgaggcatcagaagtgtcaaaagggatcatctagcacagggactggtagcaggagcaccaaggaggagggagaggtagtcaggagaggctgcatggcagaggcgcccccaccccaagctcatctctgctctcttggcctccagagctttctgtggcagcaccagcaccccatggctcccgtgagctcaccctttgtgctgtgtaattagcgcggtgtgcctcgctcttgtctctaattgtgttgtacagcgtgtactttattatatcaggatataataccgctagcctggcagttatcttgttcactaattgtttcacgtgtctgtctcgtctgccccgctagatcacctgcttctcctaagcagcaggcaccatcttttgtgtcttttgtctcccccagtagggcctagcactgccagggcatggctgggtgtcaggagcctggcatcagggcctgggttcgagtcctgcattgaccgcactgacttggtctgcagctgcaaacaagtcatactccctcctgtcataaatgagcaggtggtttctgagcccccatgcagccttaacatcctctaatgtggtggagattcctccactggttgatatcacgtcagtgttctcgaagtggtgagttgttattcctttgctcaacaaatgtttattgagcgcccactaagtgtcagttactggggaggcaatgatggataagacaggtggtatttctgcccttagggtgcttaaaagctagagaaagaaacaaatattaaaggaataaacacatcaacattatgctaagacgagaccaacctggccaacatgatgaaaccccatctctactaaaaaatacaaaattagccaggtgtggtggtgcatgcctgtaatcctagctacttgggaggctgaggcaggagaatcacttgaaccgggagatggaagttgcagtaatcacgccactgcattccagcctgggtgacagagtaaaactccttctcaggaaaaaaaaaaaaaaaattatgctcagagtcgtgagctacattcattgagcaggtattagaatacattttgcacagccttgcctgcactaactaagcaccgggggcagggggtaggtgctacagtgaggaagagaggttgtcctgttcctgtcctcctgcttacaggctggaggggaagacacacaaacagacacagaatgaaggtgtccttgcgcacatgggacgatggtatgagtgggagtggcaggcaccaggctggaaagaatgggggtacccccccacccccacccagccgccctctggagctgtaggagaatccagagaggattgcatagttcgtgcctccgtcttcctctttcccagggattggtgccatagggctggggtgtttgtgttcctcttgcctttgcacacataatttgggggaggcttgggtaggattctaaacccaaaccagatgaaggcagagcctgtgggtgcctgggagcaggggtggccccgggagcatgtggctgggtcaccctttgtaattgtagcactgtggtgaaggccccggaacctagggtggtggtggcggccggacaggtgggtgggggatgcctggcttcccatctgctcagcctcgcttggctctgaatggattagttctgtttgggttggagcttactgttgtgtgtgtttttcatcccccttcccatttgttcttctctccctggcctgagcgcctcttcagggttatgtgccttaggagccgcgagggtccccgcgtgggagggagagttgtgaagtggccattatccaaacaagaaagggagtaattggagtttgcattcttctgggcctctatggaaacagggatgtggctgggcatgggtagggggtgttgagacctcacaaaagtggggcacagtctgcagaaactcagggtacagcacagtccggatgagtgagcaccacctggtacagtgtgccccttaggttagcttgtgctgttgaaccaaagttggcgtgctgctgctgctggtcttcaacaccgctttattgttgatgagattctgaatgggcattaattccttcctgccaaatggtccaggtgaggcttctgttgcggaaaactgttggcagagaattaatattatgggcattgtgatgtggtaaaagatgagatgcaggtcttctcctaaccttgccgagtgacctctctgagccccagttttcccaagcaagtggggatgttgattcctgtcctgcagggttgttgaagggggaaatagataagctgtctaggagacccagtgccacctgtcagatgtgggaagcattcaggagatcctaagagtgtccatctcttaaatgccacaccaggggcacagagcatttgggatgttggaaatgcccgtggatatcagtggatttcctgatggggttcagggaacttcttcaaggtaacgcagatttgtgggaaaacaactttttgctttgcccttctctctgaaataaaaaaaatggggtccattgctctttttggagttctttcagtatccactgagagcccatccatggaatggacattttggagacagagtaggtgaaggcagagaaagcagctatggtcttggccctctcagagtctatgttctagcttgagaatcaaaatttcacacatgtggaacaattagagaaaaataacagatggtgtctgatcagatgtcaccgctctgtgaagccccaccctccggcagaaataatccttcctttctttgggatcctggagctgagtacaggcctgtgcggtactctgtgttgcactggtttgtcattggccatttgtgtcattaatgtgtgcaacagcaaatgttgaccgagtgtctccgtgtgccaggtaccattcttggtcgttctgcacatcctccccgagcacctgctctgggcccctgagctgaactgacatgatgatactctccactctctgggcttccaggcccaagcatgcatctcgtttctgctggcctcctgagaccccaggccagctcttcctgtgctgcctctagaactccctaagggccctctttcttggatatttggtcctcagtggccctctcctgggtttgatcttgctgtagggctgttgagttggagagggtctttgagggcttttggagtcaatgaagactctggccagccacgagtccagcactgctaaccttatcttctgtggcgctcccttaccctctctcggccttccattttcttgtctttaaatagctaggattggatggtgtcactgattattgagttctggtattggtgactgagaaggaagactgtgataggagcattccagtgtctgggaagtctgtacaaatgcatagaagcttaaaaagacatgcagtgttcagggaaggaggaattatgtcggtggagctgggaatgagggttggttcaggccaggtcctgaaggcctcggctgagctggtgtgtggcaaggagcagaaaatcctcaggttgtgagcctgccgtgtgagcgatctgggtttgatctgtttggagaaagaagtagattaaggctaataaactaatgaggggcctgatgtagtggtccaggcctcatgtccgtgtctagatggcagatggagaaggcagacactggggtggttgtgtggaacctgagaaagtgggccggcctgctgagagctggcatgatttgggggattgcccatagcccctttgactctcattttcctaataatttgtttccctgtgcccacaagggtgggcttgggggtgattgtgaatagcctagatgtgtgtaatgcattaaaaaaaaaaaaagccacctctatccaaattatcgacagcgtggtggagtaagagggaccctggccaggttctgggcatgtctgtcttctgctttgggccttagtttcccctttagtgaaaatggcagagggtaggggaacatcggaccagtgcctgaggtgtgctagcacgcccccgtgactgccgcctttgtttccaggagtttgaggatcaagcatgcagggcagggtggctccattcttggcaagtggagcggaaaataccagtgtcttgcagcaagtcccagagggtgtgggatgggtgtgtgtgtgtacttggctaggcgtgcccccttaacatctcccttggacagggcatctatgctagcctggcctgcaacctgcacagagtcctgtctcttctaaaatattgtcttccctattaaatattaataacaaccaagcacgaaccctcagtgggactgaacccccagcacaccctgggtggctgttccttgtgagtgtttgtatctccatgcctatcctcagctcagcgtggcaccttgaacagagctcgtgtgtgtgtgtgtgtgtgtgtgtgtgtgttttgtttttgttactttggagcctctgcagaatttctcaccactgccaagttatttccttgggatatatttagataaagcgagatgatggagaagtgggcgacgcgtatttgctcagggctgtttgcacacgctgaccatggtgtttttgaagctgacgtccaggagctggatcggagaagagccgcagtgtagctccttgtggaggtggaaggggtcagggagagagtgagtggcaagacaagtcctctcttctagagatggaaagcaggtgtttgggccccacaccacacccctctgctgcctcctttccatctgaatgaagtagagctctaaagctacgaaaagaagttggagaggtaattgtgagtcccacgctctgcctagaagggcagctttctcctggagccgggtggcctctggcactgcacactgataagataggaaatcagattactctgtggtttgtatttactgaaaatcctggggacagcactggctccccagagtggtgggagtaggcaggtctggtaccacacccttgctgggactgcttcgctgaacttccttcctgctgccccctcgtcagtgtgcccctcttcgtgagtctgggttcgtgccttccgtgtgaccgtacggcatggtagtgcagagaggggtccgagctaggcctccccagacctaatcagcttacagtggggcagggcagcgctcttctgtgattcaattcagagcctcggtctgcttgatggaggcagctttaatgagattagaaagcttaaccaagaggccaattaaatctgggcccatacctgtttgggcagctgttgaagccctgacctgcacccggaggcttcctgcaggcctcctaggagactggttggggagcatgagggggcagaagaggcctgcgcatctggcccagccatccccagaacctgggatctgtttcccctgctggggtcagggtagagacagaactgaggagggatctgatggaacatctggtccaggagctcccagaagctggatccctgccccctcaggaagacaggcagcttagttgttgcaaagctcactacatgattttgatgtgcaaccaggcttggaaaccaggaagtgaatccattccctttgttttatgggtacagggaagggccttctgggggcagccagccaagcctgactcctcacccagtgctcttgtgtggcatctttgttcccagctcctttgattatccagggtgatggggatggtggcgttgcccttctgttctcagacagttttttgtttgttttttgagacaaagtctcactctgtctcccaggctggagtgcagtggcatgatctcggctcactgcaacctctgcctcccaagttcaagcgattctcctgcctcagcttcccaaggagctgagattacaggcaggcaccaccacgcccggctaatttttgtatttttagtagagaggggggtttcaccatgttggccaggctggtctcgaattcctgacctcaagtgatccgcccgccttggcctcccaaagtgccgggattacaggcgtgagccaccacacccagccttgagacagtttttatgtctgtttcttcatttgtgcttcatgccactgttgtgaggtaggccaggcagggaatggtgacttctctttttacagataggcaaattcaggttggactcctgtcccaaattggtaccagacccaaaggacctgattcagggttaaggtctttcccttccattacttaaatcttccttctggttcccactggaggtggtggtgggtggtatgtgagtttgtgatgtctggatccagccaggaagaaaatcccagcatccattaactgtgaccttgtgcaagacacttaactgttcgtgtcaccagcaagataggtcggatataaaataaatgagtggattcactcacctcaggagattgttgggaggattaagtgagatcagcctcctttggtgcctacatagagtcttaggatgtgggggcttattattgttcctgggacagagagccaggaggctttgggggcagggatggcaaggctctgggagtctggtctgccggagagtgatacccagctggtccccaggggacaggccacccttggggaaaacaggtagagagggtttagaatgaatacccatttggcaagtatttctggagcacctgatggatgcgtgccaggcactgttccaggggatgcagcagaaacttgaccctcacaagtcgtgtgaggcaggcagtgcttattgtcctcgttttctagatgacacagccaaggcacagacatcttgggaaaaccggattccagacctttgccacccttgacgctggtgtatggaccggaggccacatctgtccagcctggctgtgggactccttcctgtactatgttgtagattcaaagttaccgaaggcccaaatttaaattaataattcctgtcttggccagagaggaccatggcaatggccttaaatggagttagacaaaaatagaagaaaaacagactgccttaggccagatttgcagcaaagtagggaccttgtcaagaatggtcctgctatctctgacttgcaagtttcaggctaggaacggaaccagcattcacattcagatctctccagaggttttcatgtttgtctcttccaacagttgtttgaggagaagagagacatgaaaacctttgggagttaaggctgctttttgcaccttttgacatttgggcttaccaaaatctggtctgttccttaaagttacatctttataaagcagacaaataaggaagaagggagaaatgtcccagaagaaccaggcctagctttgtccagaaagctcctttgcagtctccaatcatttgatgtttattgatagtaggcattacaaatatttggattccacttttttggaaccaacagtcctgcagggagataacctttgtctatataataagaccaggtagaaaaatgctggaagagtcaaggtagagtctcatataggattggagggtgaataaatcatcctgccttgtgtccagggtagcctaagggatatgttagaatggcagaaactagcagggaggtgggcattccagatggaggggagaagggcatgtgcaaaggctggggaccagctagtgtcccctgtggctgaagcttagagtacgagaaaagggggaggttggaatgggaggcagagaagaaaggctgagatgagatcacagccctttcattatctccttgtttttttaaaatctcttgtcaacccagagattgtcctatattacagggtgcagctcaagtcagaggtgaattgcctgcctctctgaattggtcagggagcccaagagctggagctcctgccctaaatccagtgctgtgtcggcttggttaggaggccattggtattgcatgctccgtgggatgcctcatgaaagggacacgggtggaaactggtaacttctagtattgagttccagctcatgaacctacttgggactttagtacccacttggactaggaagcagggggcatttgagctgggcattgatggataactgggagttctctaggtagatacatggaccgggatggagggagtggtgagggacctgagacttgatctgttaggggctggagccattcccaggacgtgatcagcacaggggtggggcagagtagggatgcggccggggggccctagtgagctgcagggatcctggtctctctgctctccccttctctctgcccctctcaagtttcatttcatgtcaagtgagggactgaggaagggacggggaggggaggctgggggtgatggattcctcccgcatgagctcagggcttgctctgtggtttgtctctgattgcaaaaaccatgtctgctataaatctgtggcttggagggtctagctgtaagggacagtccctagtttggtggaggagcctctgcttgtgggatgcattttcagggaagtggaggaaggtatcgcagggtggtaccctacaccctgctgttctcagcttttgtccaagcccctttttcctctgctgtccttgggccccacaagtggtgggcagccaaagcctatgggaaagtggctccctgggccagtggagcagacactcgtcttcagagaggccagggaatccaacctgtctgagaagaaatagcaggcttcatcttggagatggaagggaggctggccgagaggactgggagaggccactaggtctcagtaacccacagaggccacttgaaccccttcctgcacccagctcactgggctggtcttgtcttcttccactgtgggaatgagaacagggccccagctctgtgaggccaccccactccctctcattgcttttgtccttccttggagctacaaatgctttccccagacactagctgaagttgtctttcccattgtcttgggagggggtgatacaagggtgatttccatttttaatgaccaatggatctgggagatgtggcctgcccaagtcgtttgtgagggctttacgggcagaaggaacagtttgtggcagggtgtgtgttttgtttgttgttatttggaggggaggggcgagttgttaggatgtagccaaatggtaagttaatggaaggtgatggagatagctagtcttagagtttgaccttttagatttggtgactactcttgaaaagcaggatttcttttttcttttctttctttctttctttctttctttctttcttttttttttttttttttttgagatggagtctcactctgtcaccccagctggagtgcagtggcgtgatctcggctcactgctgcaacctccgcctcctgggttcaagggattctcccacttcagcctcccgagtagctgggattacaggcgcccaccaccacgcctggctaattttttttgtatttttagtagagatggggtttcaccatgttggtcagggtggtctcaaactcctgacctcaggtaatccacccgcctcagcctcccagagtgctgggattacaggcgagagccaccatgcctggccgaaaagcaggatttctgcaagaattttatttatccaaaaaatatttactgagccagcatcttccctgtgctgtgcacaccattcctgctcccatccctggaagatagctggctaatttaataaggaattaacagtcaggtgtgacaaacactgtgctgagaaacacataaatgacgaaagggtatcacccaggcctgagtagagaggagaagagtgttgcagagagaggaacctgcctgtgcagagggtggttgctgtattcatcaaggaaatatgtgtgaaagaaaggcctttgtaagctggtactaggtactaaatatgtgtaagtaataataggttattcttctctgaatgggaccccaataaatgttttgtaaagaccttcctttgtgttttcaataccatatcgatgggtggcatgagtaggggatggaccacctctatgagaagtcccgtgtttgtttcagaagctgagtttgggtcagaattctcagtggatgaactcccatgtcccttcagaagcctctgaccagcccgcgtgcctccgatcctcccaggccccacccccttagcagatctctcaccgggatcctaagcgatgtgtgtgttcttgggtgctctggccctcttcttggtgggtgcaaacaagaaagccctgctgtgtgcacctggtagatgcccaacaaataatctgtagtgagctccgaagtggcagccccgccttgccctttagctttgtggctcccaccagactttagcaggccacagactggggtcgcaggctggggctgtgtcttggtcagaagcaggttggttcttggtgggtacctgaaccatctcttcatcccctctgtattacttttggagcaaaccatccagtcaccatcctccaagagtctcctctgaaagcatgccaggctctgttctagaaggccacttggcagggtagggatgtgatgcctcgtggaggggctgataactgtgatgccagaatctgagttatctagaatggctgtttttggttcctaggggtatcaggtaccagagatattacccttcctgccccagagacagacacatgtacatacacacacacggaattcatgtcctggtgaattctcctgttggaggcattagcattcccttgctttggcaccactccctctcgtttgttcagagccctgagggctgggattggggtgggatgagggtcaccgctgtctggtctgagtgcgacaaaccttcctggacctgcgccctggagtctggggtttgaagggcagcaggggtcctcagagggcttgtgcagggcctcgctcacaacacaggagtgttcttgggggaactgacatgaggcttcacagtggccagggcagctggggccgtagaggacatggcctggactctcatcccttcctgtagcttgggggctcacccaccctgtcatttgtacatgaggcatctggggctctgagaagggaaggggttgccttgcttttggttacctagctagtttctgtcagggttttcgttaaggccaagctatagtcctctcttgtgtcagtctgaagaattcggtagaggggaattaattgtggatgttgaagtcaggtagacctgggtttgaatcccaggactgccatttcctggcatgcaccaactgttgcattcctcccactcccttaggcagtgcaggggagaaagagggagggcctagctggagcttgtcacctccaggggagtagagtcttggctgaagggtctgtccttggcttcctagagcactggagggcccagctgcaggcccagccattgctactcagcacccacctagtgggtaagggggtcagtgtgggcctctctcccttccttctcagctgtatctagcaggtgcccgagagcagccttccaggggctccagacaaggttccccattggcagcactggtgcctgagcaggatgcgggctcgcacctggatttcaggcaggagaaccatctatgctattccttgcctgacagctgggcgtggagggctgcctgaatggacagcagcagacactcgaataagtgcccagcgcttcgtagtgttgttgggtccaatttcctttgctttgtgacctacatcattctttatttgctaaaccctctgagcaggcagcagtaataaatcaattaatgactctgatgaatcgtttaatggctgacaaaataacactaaagccaacagcttgcatctctccagcagtaccaaaggacgctggttgactcagagtgggggacgaaacagagactgttagctaaattagcgcaattagtgcatgctttaaaggcttagacggcatctgctcagcgccgaacccgtgtggcaactgtgcgctggggtggctgtgcagaccacggtggtccactgctcactgccttccctcctggccaaggagctcaagggctcccgactgttcatttacacagaagaggcagtgttgggtttgaattatgcgccccttccctggcattgggggacccgggtgaacttgtcagactgtgtacattttgtcctgtcacagcagaggaggtgagggaaagtgacttggtccccactaaatttgatgctcactgaggagagtgtgggctcccatccttgaaagatgttctgagggccctgcctttaatgatttattttaaacttaaaaaaaaaaagtttctagaagcgggtggttttctgttctctgcacacctcggtcctggcaggattaagttgtcattggaactgagcgtgtgcgcgggtccacgccagggaattttccactttgcagaagcaactgccagtgttcttgttaaggagctgtcactggcctactatgacatgtttgtggttgtaagtagctcctttaagacagtgggaaatgtgtgtgtgtgcgtgtgtgtgtgttttgctaatggtgtaaactagggcctgaagctcatttctctttaagaagaaaatcaacgttgtacaaataccgagctgttgatccactctgcagtgttcatctaggggggatcctctagcccttaatcttccttgtcttgcatgcacatgcctgggacctgcgtcctgtgccatggggcccagatgggaggtatctgcctgtggaggagggtgcactggctgggatccactccctcaccaggtactaattattaaatacatggggctccacctcttaccaaacagtgacctttgatccagtccccagaagaagccgggtgcttcctgggatgaatgggcagggcccggcagtatggtggcctcagacttcccagcccagggaattcacttcctcctaaggtggccactaagaagagagaggccccttctcagaagaccaagtctttccacagctttcagcccctttttgtctccccatccccagcctgctgtggtcagggaatcttaggacgtcagcacgtggtcctttacctggagctgtgtctctggctctgggccgccggttgctgaacccgtaccttggctgagtctggctgggcaccttacctaagggtcatgtttaagttccctatgccccccacagagggtagggggctcccttccttagcaaatgatgaggggtgcagaaggtaaagtgaggtgcctgaggacttggcccctggtgaatggaaggactgggccctgacctgtttccaggtgaccacttttaagtgtcgattctgaaatttgtatcagagaagctgaggtgtggccaagagctggggctgtggttttagcagatctgggcttgacttctggttctgcccatttccagccatgtgaccttggacaagtgcctttactcctcagagcctctgagttctggtagtgactgtggattgttggaaggatggagggagagagactggatgagccacaccatgagctgggtcacaagggaccgcctggggacagtgagccttctctgactaggtggctggctcctcgcctgtgggggagcccccctatcctgggggagggaaagcgaacaagccccacacccaccccctaccctggagatggtgcagggggcgggtggcgtcctagagggatttgctctctaaggaaaggctgtcaggaggccctgtgcccagggagggttaaaatgacagcataatctctcacccctgtatcacctcctgcatcctcgagtcctgccgtcctttaaggccccagctcaagtaccatctcttccacaaagcctccctgatccccctaatccccgctcacagcgcctgcccagagcaccttgcctgtccctcagttctctgtcaccacaactccttgcatcctcctgacctgcagggcagacctgcaacctgtcatctgctctggtgagcacagcgcagtctgggtggccccagaagcgagtgtttgctgatgcatctgatgtgtaaaaagcactaggaacctttttacagccccccaccccaccccccaccttgtttctcctcctctcagggtaatttgccagttagatccaacagactcttcagtgggatcttgcattccttgacacacatgtgtgtgcagacacacacatacacaccccttggtgaatgccaactcattgaagtatttgtcagaaagagcagagctagaaggtcagcctacttggggaagcacaaaaacatatagacagtctcaaacacgggaatggattgtgcttctctcatgtgtttaatgaagtgccggctatttcttttcataagagtcaaagcacacagaactcttcctgggaactacaggggtgagtgggacattactgttttttttttttgtttttttgttttttttttttttttggagacagagtctagctctgtcgcccaggctggagtgcagtggcacgatctcggctcactgcaagctccacctcccgggttcacgcgagtctcctgcctcagcctcctgagtagctggcactacaggcacccgccaccacacccagctgattttttttggtatttttagtagagacttggtttcacgtgttagccaggatggtctcgatctcctgaccttgtgatccgcccaccttggcctcccagagtggactgtggttttgttttttgaacccaagataaaaggtggaggcacagagggactaatgttagagccacttagctgcctgaccttgagatagtacagctctctgtgcctcagtttccttaccaggaaaacagaaatgacatcttcccagcgatgttggggaataaatactaccctccccccccccacccctgctgatgtatgggatcaaaatgaaaaggcaggcacttctccagcccctcttgcattccagggtcatacccaggtggcagacatgagctgggacttagtaaaataagctcaggtatcaagaccaccctcatttgggtctgatggcctggccctgacaggttgaggcttttgttgtctatacgtggcccttttcaggtcgcttgctgaagagctccttggacatccacagtgtcactggagcagcaggacatcagctgccttgtgtggagtccagggcccggggcaggaaggcctgatcagatcacacagtaggtggtttgccgccagagctggaatcctgatcctgggaccctcagtgcaggactcttttgtcttaataatccccaggcccaggcggtggtgggtcctatggcaatccttttttaatatggtttgtgccatgtctccgctgggagcgaccccaaattatcacagcccgcccccttctgaggcagccaagaagctttttgtagcttggggcatctactgttggacccagggccgtccattggtgccgggagacacatccatccctcctcccacacgatggccccctgactatttgaaggcagggatcttgtgtcactcctgtgtgtcatccaaacctatttttaacgtcagctggttctgcctcttcacgtagcaacagctctgttttctctaaactgcacaattagagcccctgttctccaaaactgattctgttctgtggtctgcatatgaaaccaggaatcctcttcctgtccccttcccttctttgaaccccagttctgtctgtcttggcctttccatctgggtgatgacattcccccggtcgcttccattcctgatttatatctttagtttgttgttgctgctgaaattccctctgggaaacctggccccagagggacccgggttactccatagtttgcacagaagcccctgtcttgctgaaaccagtgccagcatccctccctccctccttccccaggccaccagacaggcgtcacttggaggcttcctgtctcacttgccctctgtatgtagtcatcacaggagtgccccaagctcccttgagtgacctccatttcccagctttgagcacatggctccaccctcagcacacacctcccaccccctggtgttttgggccctgggccacgcagcctgtgttgagtttcagtcaaggaagtcgtctgcacatgcggttctgcatgtggcccccaagctgctgcacgccaaggcctgagtattagggcggggcaaggaggggaggggatttgcagaacaaagtaccattttgcagccttgtaaatcagtcaggaggggttggccgacctggcaggagtcccacatttccctctgagcatttgtttttattcagttttccaggagcttcctgtgcctagaactaattttaaagagagggttggagcgggggtctcaggctagtttgtgagtgaggatagctggggttcttgaaatgaggccagaagatagtatcttgcagggaatgcccctggaccattgcttcttgaaggaaaagcatcaacactgttgcctactctgagatgcttctctctcagggtgggatgagaggcctctgggaatgtggggactcgtcaagtccacttgctcctggaatttggggtactctggtggtattgggatttgttgagtgagcatgaaaggtccctatgcccggcacagggtgaggtggggcagtagatgtccccccgctccgccattgcccagagcagaaagttccattccttagcctggcttccaaggcgctttctcttggaagcaccgctctgaggccccctgtttgaaccctgcttctccaccctggaggttagagggggaatatccatctcctagggtgggactggtggtgaggttttcaggtgtccttacggagtgggattgctgaggatctctggttgcagtggcatgtgtctgtcccgttggagcatggatagggcagaggcaggggtagtccctgagccccatggctgtgtacccatcctgggatcatcaagaaaccctgctctttagagatggagctgtgggatcagtcctcttcacaagtctccctggctgtgaacggcaaacttcaggcagtgctctgggaaagcacttcgggcttttcaagttgactgtaggtttagaggaggcacctggctggaatgggcctcatcaccctgtttaaggcctgtttgctgtttagaaaagaattttaaattagctttatttgttgtttttgttgttgttttttaaagtgcatgttaccaaactgcatgggtggtttgagttggctttcttgagtccaaaaagtggataagcattggtgaggaaggaaggcctgggcggttagaacccaatgtcacccactgttatctgtgggctcagataacaggtctctcggtagtgtttaatctttgatcacaaaatggcctataatgaacagagaagagttaaaacccaggtgccctggaaagagggttgctgtcctgttcatggaagagctgctgtttccagacctagctccccttggtgtgtagacttagctggggagagcagcttggaagaagagccttagtggtcatctcctctaacaccatcattggacacatggggaaactgagtcccagaacgagaaaggggcctgtccgtgggctcccagctaggagatctctagcttctgaatccagtgttcttttctctcttcttccgtgggggacttctagcccatgcacccactgcagccctggcatgctgtaggcctcagtgaataatgggggttttcaggggttttggttttgtgttgttagggaaaactcatgagacgctttgctgagcgccttaatggagctccagctcaaagttggaaaccacagagggaggccgattcctagcagtctggaaaggcctggctctggacggtcagctttgagcaggtctctgaattatacacgtagtaatcatgattgggccactgcattccagcctggggaccaggtctctaattataataataataattttaaagttttttttttaaaaagtataacttacccgtattctagatcctgctaatacacctgctgtatgcctcacgttgtgctgggtctcagagacaggagaaacagcccctgctgccgttgagctgcaggagggttggtgcagggattcagcgtaatgttcatagatgtggttggggggagggtaccttggtttagattttgtgagcaagttatttctgagcctttcccaacctcttaactcttttgttgccctataccactggttgctgcttttcgttttcttcttcacacttttctgccctttttaaagttttttgttatgagcacatgtttgcttcataatcaaagaagaacagcaataactatcaaaattcaaggcacaaatttaagcactgcaggacgacttagttttgctgcttgagaagctttaaatgataaaggcgtctcctcagcttcctgccccttagtcaatgctaacatggtcttggttttttgtcctccttcattggagaacagcaaaactccatcttccaccccacatttcagagaattacaccgtgcatttactagaaccatggtgaccctggccgttgcattcaaagaactgtggaccatccactaccttcagttcctagaaccattgactcactcctgatctcataggaaaacatcttagagtgaagagcctcataaataaggcgacaaagtacttgtaggttcaagttttcatttaattttttttttaggccagacacgatggttcacacctgtaatgctagcacttttgggggctgaggtggcaggattgcttgagggcaggagttcaagaccagcctgggcaacatagtgagacctaatctctacaaaaaattttaaaaattagctgggtatggtggtgtgcacatgtattcccagctacctgagaagctgaggcaggaggatcccttgagcctaggagtttggggccatagtaagcaatgatcgggccactgcactccagcctggggactaggtctctaattataataataataattttaattttttttttaaattataacttacccttagtctagatcctcaatatataaaaaatcaaatacccaaatagcaaaggacatgaatgatttgccataaaattagatctacaagtggccaatgcaaaccatttcaaaaggtaatgacctaagaggtaactcagaataccgaataccaaagggatactaactgccacattagcagacactgagatttaatgcctgttatttcgttggttaataggcggggggtggtggctcatgcctgtaattccagcactttgggaagctgaggtgggaggatcacatgaagccagcctgggcaacatagtaagaccctgtgtcttaaaaaaaaaaaaaaaaaaaaaaaaaagtggttaaataatggtacataagaagaatgaaattgttaaatgtaacaccagtctctgaaagaacctgaagaaaaatgtagatggatgtttaccttaccccatttttaaaaaaagttttttgctcttgctgctgaggagtaattgttggctgttaatcacaaaattgccattttcacagaaccactgaccacagaaaaacagtaatgcagccagcagtaatgcagctaatggataagctggcgattccctcacgaggccccatctcagatagtgccgggcaggggcaaggcaggggcctgtgacctcagacctgggggatggggagatctacaatcctaatttttggagatgcttgaaacttgtacacattacaggatggttagcaggatagctcttgcagagagggctgtttttctgtaggcagaatcattttgaaaagtaacgtgcggcttgcccattctcttcatctggggtctgctcaacacccactgtattccctgtatttctttgttgctagattcacagagctgtcccagcttacaaaacacagcccattctgtcactttatcccccacaaccctggtgaggacgtgggacaacagctatctcattttttacaggaagcaaattcagaaagtccgagtggcttgcccacagtcatcccacttagtagtagaggtgacagtgctgaaaaccaggtgcatttgttcccaggtctgttcgtttattttgttgcatgcagtatattagtgagatttgcacattacctcatttcctttcatcaaagttggaagttagagattctggttcctttttttttttttttttttatgagatggggagttttgcttttgtcatccaggctggagtgcagtggtgcaatcttggctcactgcaacctctgcctcctgagttcaagtgaattctcctgcctcagcctcccgagtagctgggattgcaggcgcccaccaccacatccagctaatttttgtatttttagttgagatggggttttgccattttggccaggctggtctcaaactcctgacctcaggtgatccgcccaccttggcctcccaaagtgtcggggttacaggagtgagccaccacgcccagcctctggttcctattttactgccaatgaaaggaaagagagtgacttcttgaaggtggtgatgggaggctgtgtttctaagaggaaaaaaggcgttctgtttcctgaccccaaggggctcattcctctttcagagaatcagaaccctgggagatgattgatgaccaagtttcactttctcagtcatggtggggtttggggaccaccaaggttggaggtgggcttcctgtagaaggagcccctgaaggcctagaatcagtgggaaggagcagggcccggttccaggtaggactgtcagacctgtggcttcctcagggctggggcccagatgtctcagcctcgccccgccccgcctgtgtgagcacggggccaggcacagacgcgccgaccacctgaataggttgcacacagatcctttggaaggaggccaggctggggagagcaatgtctgctcacccctgggaggcatttgttgaggcagatataccaggcaaatgccagaacagcagtgtttaaagagaaaaggaatgacggtccccccacttcgcgaggcccctctctctcatgagacacctaggaccctgcagggccaagaacacgctctgccctccgtcaccctctccagcagtgtttcccagttggtctgttcatttattcgttgagtcatggatatttattgatcttttgctctatatgacatgccagccacttgcagagggcacagaaatttataaatcactggcctgccaagagcttctcagagtagctgggcagacacggcccagggccatataatgccaggagcagcacattggccatgcacccctgctctgcaccgcaggaagtacctttggcactttgtctcaggctgtccttgcaacctccctgaatggtggacattgtccccccatttttttattattattattattattattattattatttgagatagggctgaaccttttgggctcaagcgatcctctgacctcaacctcccgagtaagtggaactacaggcgtatgccactgcacccagctaattttttattttttgtagggacggggtctccctatgttgcccgcgccggtctcgaactcctgggctcaagcgattctccagcctcaacctcccaaagtgctgggattttagttgtgagccaccacatccggccctcccattttagagatgaggaaaaagagcctcggaattcgttgcttgctcagtgggggccggacctgggaattgagtccaggtctgagtgtataagccctacttgtgtcctgtcagtgggaacatgacacttccctgggacgctaggagggctttaagtagaaagtggcctgtgaggaaggtccacggggaatgtggacggacagggagagccaagtccaggggtcagaactctgtgtctctggttgtgggtttggccactaactctctgccttgttgtctccacagagtgcagcagctgccccgagccccgtgcttggcaacattccccccaacgatgggatgccgggaggccccatcccgccaggtttctttcaggtacgtgcggggcccgtgggtcttgtgctccaccttgtattccaggccgaggccctgggcaggtgggagggcgggagagaagtaagtagctcagtttgccatggtctaaatacagttgctttatgctggttcaaatccttcccttcccatccctttcaacagtccttctaaaagctgagagggagaaaaagatgggaaagcagaaacctcctgcattgcctgcacttctgctggagtttgctttcttcatgccagcttcgtaggcgcgacacagtctgcccctggccagggaggtggtgggggctacttccaggccactgtggagctttcttttaacaaaaggctttaaaaaaaatcagtaaattgttctttgtttctgttttgttgctgctgcttttgtcattgtttactttacttgtccaaatgacaaaccttaggcgtaatcttaaaaaaacacaaaaacccaccatcctggcaggtctcagaatcctttccctctggttaaccacttgattttttccgagtgtgatcacagacagcatcccacaagcatctgtgcccgtgctctgcccgccacaggcaggaacagatcccacgtgggtcgagagtctggccttctccaagagacaccttgtttggctttttctggggtgtgtgaaattgggctttctgttttgccaggttgggcgcggctgccaccctctctgcgccgcctcctctgtctctaccttctcctcggcggttcatgtgatttaagccaacttgagactggggaatgccatcttagagaggtacagcgtgcagggctgtaaggaacttttatgatgacactctcgatcataacatctctcgttctttcaagcctgtcggcagctgagtttgagaatccgcccgagttctccacaccttttgaaagattggcactcccagataagaacatggaaagagctgttgtgtggaaaaggaggcagaaatttcctctgtacagccctagaattcagaactaggaccagtgaggcaaagtccaaggacacttttgcttggtataggccagaatttagcacctgtgctcacaccacatcaaggcagggggctctctggccctagagatgtctaagcaaagacctgacaaacgtctcctagggatgttaaaggggtttccctctaggtgagagatgatctggaagatgattctagttggcaagattttgtatttcggttggtgttaactcctgagagaagagggctgggacatgctgctcaccagctaagaaggacggcagtgaaattcaggtgttccccaaaaacagaagtggtaggtcacatgatggtggtgggaggagagagagggatgcaggatggccatccggggcattggatggccacatgtggatctgtatgcattcccagaacactgccaaaactggagccttgtccaaggggtggagatgagtgtagccccagaaataggtgtgtgagctccaggttggactggaccaggcattgctagggtctcagcttggggcaaggctgcagacatattaaagatgggttgagagttagaccttaaaatactggaaactcatggacccaagaaaggcagtagccagaggggctgctgtccttctcccagggaggaaatccaagaggccagcgtgtgagaggttcatcctcaccaaggcaggcatcttcctggctgctgcagatggcgccctgcacccatcagcgggcctttcccactggcgttctgtccagttgggaattctttctaggctcacatgccatggatgttcttgagacagtgcagatgtggcttccgtgtctggtggacccaccgaggtaccatgcttcatctgtgtgcctcctgattgaggctgcttgccggcatctgggtgtccggtgcagattagaccactgtggtagaaagaggtagacaatacctagttgtatgttttaaaaataggccattggcttctattttggcctgggtctaggacaaggctcaggtctgcctgatctgtgggcagctcccaacttcctgctttggtataatcgtccatggctaaggcctaattccagacatacttcttgggccctcccctgtgacgtttggggtgtgtggtcagaaagccaagactgattcctgtccttatttagccattactagccaccatcaaacagaggtaacttttggaccttcttgacttgaggtcacctctgttttcccaggcacggcgagccatcaagagctgacgtggtcatccagtagacagcagagagcaatgtcttggcctctctgcttcctgggtgacgttgggtgattcctttctctcacttcccggcatcatttccccatcagtcagatgcagggggatgggctaggccaggtacctggcctgatccttcctggccatgatgctgaaccgctcaggctgggacactgccaaggggaaagggtatctctctggaaggaggtactggctgcccatttccggagtaggcctgcttacaacaggaatattagctattgattgctggccctgcccttcactagtattgcagccggccactctgatattagaagggaaatagagatggtatcgaggattttatctgttaccaacaattgcactccttcccctgcttggccaaggcctgggtaggaagctctgctgcagaaaggctttgcaccagggagtcggcttgggatggctgagccagctatggccagaccctggcctagggtggccagcccagttttcaggtcaggacttcacccctagcctggtcctaaatgtagaagccccaggcctccagggttgggtgggagagagcagctgcccacctccatcccagcccctcggtaagcaacacagggccttgcttctgcaggcctctgactgccaggcttcagctcctggggtcagaagttttggccacccacaatgagggttggccatcagctttctcttcttccacgtccaggtttccaaggcgggcagtacctgtctggtcccgtggcatgagatgtctctggtagcaagttaagggctggcagggagatggcttggaaactgacctgaccacacctcacctttaaaaaaaaaaaaagccctaatattggcatccccagcacctggcatatactaaggacctagtaaatgtttgaactgagtttatttgtattgctcacattacagaacaggagcccaggcagccccaaagcactagatccaacattctgatcagggagggcctaacaggaagccagcttgggagttcaggagtggtgttctggtgttttgcagcagggaaggacagagaggacttggccgcatacttgctgagtgaccttgggcaagttgctccccatctctggaccctagttttctcaccagtagatggagcaggctggaccaggtggtctctgagggcccttccaactttgattttctgctttggatccagatggattttacataatcaagcagtggcattttttttttccacgcagcttagctcggttgggctgcacatctggcaaacccagcttggctttggccagcctcactgatctgggtgggttccctagttcccccttaagggggacactgtccagtaagaatttctaagttccttggccctaaggtggtcctaaggagggcactgtccagtaaggatttctaagtccaaaacgggactcacaagagggcaggggtcatagagaactgagcattgggtacaggctgtttttcttcttgttttgtttttaaattccaatagttgttttcagttacatagtgtttttaaacatgcaacttactttcattttcatcacagtgtttctgcagagaaggcatgcagattgggaaagtgagactcagaaaggtgaatgacttgccccaagttaaccaggggctgtaatcagagtctaaacccagctttcctggttcctcatggggtgctcttccacaaacactccaaagtccaaatgtggatgcacatctgattggatggcggaagcagggagagtagagaattagataaaaggagggagagaccgaaaggagatagagaaaccataactcttatctaaagaagtagcaaagaagtccccattcaaatgccagctctgcttgatgtgtggtggctgctgagaacaccgtgagaatgattctgaagctgtgtgtccaggctcaacagatagtgactggcaatgtctaccatgaacgtgaatgtgtcggtggtggtacatatcctctttgccatccctgatgtagtccaagcttctcatttatagatggggagatgaagtcacagaaggagaaaggactgtggttatgactgtcattgaccgtctctgatatgcaaggcatggggcttggttccaggctcgaactgaatcaaccatagtctgcccacaggagcagccagcctagcagagagactgacaggtaacccatcccctgtggcaggacacaggagaggcctgtctgccaagctgagaaatcaggagggcattcctggaggcagtgcagccctggctgagatggtgtctagaatgaggtggttgacaggtgctcagcgggagatgaggctggagaggttgccgggcaattgttgaaggaccttgttgagtatgggcttgatccagtgggcagtgggaagccagggcagcactctgggctggataatgtcttggccagatctgtgttccacaacagttactctgcagttgttccagtggcttcgtggagacggggacttgagcactgtggccaatgctcagaaagtagctgacacctttttttttttttttttttttttttgagacagagtctcactctgtcacccaggctggagggcagtggcgatctcggctcactgcaacctccgcctcccgggttcaagtgattctcctgccaaagcctcctgagtagctgggattacaggcgctcaccaccatgcccggctaatttttgtatttttagtagagatggggtttcaccatgctggccaggccggtctcgaattcctgacctcaagtgatccgcccacctcagcctcctcaggctgggattacaggcctgagccaccacgcccggccaggaagtagctgaccatcttgatgatggatgctgcgtgacagagacccagcagaggtcacagggttaaagactgccttctctggaaaagtcctggaggaggggtcccagctcctgttgccaaaagcttagctcatcctgctttgaacatctagatacttgccatcttggtgaaggatagcagggactttccaccttggtgaaggatagtagggagtatttgacacatcccctttccgttgagtcctcattcctgccagccaggcccaccagccttagaaagatgttgaggtccctagagaactcttcccattggttatggggagagaacgagaaagagcaaacaatgtgtgtagcccaaaagccggagatatgacccagacaataagaggggagagaaacttgcatgacccaaaatctttccccatctcctgcagaagtagctggggtttctctgggagaagggcagcctcctgagggctctgatggctgtcttgaagtatctgaagttctgttacggagaacctgccatgtactcagacatgcccctgtgagctctcagccccacattccaagtccttgagagaaaagggaagccaatttgaatcattgtatggaagacatttctgtcatctgccaaattaatgatgaagtggtgagctgtttgacagtggtggtaactaagcagtggcaggatgcccagtggagagccttgggcactgtgagctgtggggtgggtgatgtgttcacagggagggtcaaagcccagtaaatgagaacatacccctggcagcaactggggcagttcccaaaagctgagccaaatgctgtccatttcctgccctgctctccagcgggaagcaggagccagcagagggagcggacattcctcctgccagaaagctgctgcagcaggaaaggcctctctttgctgacgaggacaagtttgtgacaaggggagacttgggaagaattaaaccaccttgtttgcttttggtttccgaagcctgttactagtggaagcttggtggcggggcgctggggtccccacccatctgacagatggtgaagtgaaggcagggcaagggaaggagctgagtccccgtcatgtgagacccggacgggcttgcttggtcgtcccttagcccctcggtcagacgtggtgtgtaagggcagggacctgtcagccacccaagaggcagccacggaccctgccctcaaggggctcatagtctggtggagggggcaggcagtgactgagtgccacgctggagaggttgacaggaagaataccgttggggccaggcacagggcacagccagtatggcttgtctggggaagcctctccgagggggtgacatttgggctgaggaggaggaggcaattggcagtgaattgaggtgggggagtgtgccaggcgagagggagcctgtgccaggatgtgatggggcaagtttggggtggcaggggcctggactgcaggctggggtgtggggatggagccaggaatagacacaggaaggacttaaagttggggagagccatgaaaggttcctaataaggggagcaacgcgatcccaggaagaggttccatggcctggaggggctgggcccttggccggctggccagtgtggagtccagctgcggtcccctctggaggtggccatggcccgagcaggagtggcggctgggtgagactgagggcagctttcctgcctgtgactggtggcctctagtggatgttggagcctaaaggaggcccagcttactgcccacataggttgggggcaggaggcaggtgtgacggtgagaagccaaggctggtgcctgctgtcttagcagacgccttacctggggctgcccagcctagccctccccacccaccccagccagtgctctcaggcctgagagtagaactgtctgacaccctcttatgttaatagttgctggtggaagcactctccaagtcagaaaagctgttccctgctgtgatttcatttgattctatgagatagtcctaagaaccaatagcattcccactgtatagatgagaaactgaggctcaaattggccagttgctcaggaagacaggcctgggtggggcggtgggatccgcagcttcttgataactgcctgtctgtggggaaataaaaccccctccccattctgggtctcgcctggccctctctgcttccctgcaggtggggggagtctgtctgatagatgcagcctcctactggggaagaggacagaggtgctgtgtcaggggtggatgtgttcactcctccaggggacagaagcaccaccccctccagctcctccgccctgctgtccgcctccagactgacagaaggcagggtcacccctgctgagaaggattagagaggaggtggggcgccccaactgctgggctccaggccacagttggaggtggggaaccactgctcttccccacccctaggccccacctgttccaaactgacttggctctgggagcggcagcccctcctctagttactgtgatgaagccccctatcctgggagtgggacactctgggataccagccctgctgccaaattcctgtgtgtcctcggggagccagccttctctctcttggccttagcttgctcctctgtccagtggggggtgctggccacttggaagcacatgggtccgggctggtcctgccctccacaatctcctggccagtgaaaagaggcctggggcagaggagagggaagaaagcctttttttgcttgccaacacctcccctgcaaaggtcaggctgtgctcccttccctgcccggcagccagcctggtgcctgacgtctgcccagcggcagatgaccggcactggggctcctagcaacagtggacaaaaggttactcctgacgtgccaggctgcctcggcggcggctggctcagctcagtcgccctccctcttaaataggaaaaaaagttgtggccctgacttgtgtgcgtgcctgtgtgcacgcatgcctgtgtgcacgcatgtggatatgtttgtgtctgcacacttgagccgcctctccctccccctctgaaaaacgtgaactccacatgtagcgccgtaactctcactgatgaaatggaaagttgaacataaatcaatgtctgccgcccagttagctatgcatcagcaggcagcgcctgggagatttgctcggtaacaaagcacccaacagctgcttgggccttgactgccccctaacgcagagccagccccatgctacagagcccagctgggctacacaccacgtcctcctggcctcccaagtgcaggatgggactctcactcctctcttcaaccttttgagggagggaagggggaaggagtctctggcctcttggacttgggaggcctgggctctgttcttgctgctgctcctggcgaagccctcactgggggtgtaaactgactcccgaatctctggcttctgtggatctgatactggaaggatgggtgtcagtagctgcgttcacctcatgcttattaagagcttgggctggtttatcctttctcctttggacctgagtttttactttgcgttttcttagaatggagtgatttttccctgtgcctggaagctgctctgccgcaggtcggcagttctcccagcactgtaccgtggctgctccctctgcccccacgaggtccttctgtccttcatagggggatgggagtggagacccctgcggggctggagagtatttttgttttgtctcttcatagctgactgaggggtggactctcttgctcctgtccccacctaccttctcagcaaattgtactgaggtttttctccctttttttttttttaaaaaaaaggtcaaattccttagcccttgtagcagaagaggtttgaggaagagaattccagcagaatcctgtaataacacgcctcggcatgacatggatcaggatagaccccctgagtaagctcatgccacagtgggaggaacctccccttcaggggagtctgggctgggctctgggcccaggcactgccctgggggtcagaggccattccagcatctagctcagtgtgaggcactgttctaagtgcagggaaccacagtatggggtcaggttcatgtcctgtttctgcctaagttaactcccaggcaacctctccctgaaacacttcctctcccaaagagggccttagaatccatgaagctcctaggccaggcccacctgtgatcctgtaaacttttctctcagaaaagccccatctcaggctaggcatggtggctcacgcctataatcccagcactttggaggtcaaggtgggcagatcacctgaggtcgggagttcgagaccagcctgaccaacatggtgaaacctcgtctgtattgaaaatagaaaaattagccaggcatggtggcatgcgactggaatcccatctattcgggaggctgaggcaagagaatcgcttgaacccaggaggcagaggttgcagtgagctgaaatcacaccattgcatgccagcctagaggacaaagcaagactctatctcaaaaaaagaaaaagaaaaagaaaagaaagaaaagccccgtctcttgtttcttgctcaagaccaaatggtgggaaagagactggggacatggtggggtagaggggcacacccttcatgaagtgccaggtctgtatgcagcacaggcatggggttgggagggcacccagctcggccgtcagggaggccgcagagtggctgtgaacagggtctttggagcacgatggccctgcacttggctggcagtgtgatcctggcagtgacccagcctcttcaggcactgtttcctcagctgtgctgtaggaacagtcgcgcagcaaatcctaccgtgtcctttttggagctgtggtgaggattgactatacatataaacctatattcaggccacacgtggtggctcatacctgcaaatcccagcactttgagaggccgaggcaggaggatcgcttgcagccagtttgaaaccagcctgggcaacatagaccctgtctctacaaaagaaaaattaaaaaattagcgagactttgttgcataggcttgtagtcccagctgctctggaggctgaggtgggaggatggcttgagccctggagattgatactgcagtgagcctcgatcacaccactgcactccagcctgggcaacagagcaagaccctgtctcagaagaaactcagaaatctacattcatgtcagtaatggtttattattactgctgtggaaagatgactgggcttcaggatccgtgttgaccagcagctaagcctggagctcccagcgtgccagtcagctcatctgtcccttctgtcttggacagggaggtgctgggtcccatccctccttcaccttctgtgaaggtgatccatgcttcctggtggcctctggtgtcacacagcctgggtgggcacatgggtttcctcgagaaagtcagttcacctctctgaacctcagttgcttcatctgataattgggggcgatgataggccttgacatcttaggtcggctgcgagaatgccgtgagatgatgtgtatgaagccccacctggtgtctgtgctgggttggctctcgagactttagagttgttgtaggcgtgtctgggactgtactgttctagaggcccaggtctttcagtttacccaagaacaagagctgcctcagggtttctcctctttccaggagggagtcttaggggcatggcacagccttagtgacattgatgtgtggaagaggttctgggtatttttgagatccgctagctttttagtgtttaacccttcagtttgaccaacatatttgacacacctaagcaccaggccctgtttggccctttaacacgttacttcccttcatcttgtccacctgatttacctcccttagcccctgccaccttgactcctagtgccctgctccaccgcacaggagctgccgggggaggtcgaggctgggaggcaggtgttgtgtgtctgggaccctctgattcttttcctcccgggcttgctaccatgagtctgatggagaccagctctgacctggggagctgggtcttcacctgtgcgcctgcattctgtcactggtgaatttcacctgagtatcatttgagtttgcgttccccacctgtaaagcagaagcagctctccctggttcatctgggagatgaacacttgtaccagcataaggtgtgtggtcagaatgaatggcagatgggaaatccgacaagtgctccttcccagaggctgacatctggtcattccttccttcagcatacattcataagccacggctttctgcccagccccgctgtgctcccagggttgggaggtagggcagcctctggcccccacacaatcatcgtccacagggcagacctaggctaggctaaccaaaggtgagcatgtggctcattctcctctgtcaggtgctcttcctaccagtggtgccccttcattagaagaatgaagtcagagctctttgtggtctagccctgctaccctcaccccactgttggaccagctgttgttccacagggcaagcaccagagctgctggctctcagacctggcctctgcccctccatcagtctgctggggattgttctataggctgcagccttctcctctccccttcttgaagcttcttccctctcaggtcacttttattcaagaatactttgacaaagtcttgccctttccttggcccaaggtcaaaaaagttatgtccaacatgcgtatctagctaagttccgattcgctagattaattgtaatagccaatcccaaggaacttactctggagctgtagaaaaggtccaagagcttaggaacttcggtctgttttgggaagcagctttcccttcctggaccatagtgtccccacctgtaaatgcagcagtgttagagagcgtggatataagagtccagtggtgagcagaagagacctggcccctgtcttctgggccgtcaagggctttgggggcaaaagaaatgggggactacttctagggccagatgactctggtggagtttgctgaagagcacccagcattgggtggagtttctcttgttgaggggcatgcttccaaccccaagagcagctcagattaggacagcttacgtgttgtaggcaagaggggtagctccgtgggctaataaggaaggctgtgtgaggtaataaggagggctgagccaaagaaaggaggttcctgaaggattccacgaggcggggcagattccgagccacagcttggtgtattaagagctacccttggtaagggctgaactaagtacttgactcctgatagttagacagttctctgtgaggcaggtagggtgaccacattttacaagggagataagtcagtttcagagggagctataggccgagctccaagccccatgaatctggggcttttccagcagcaccacagagctgcttctcattttccgtcaagtttgccaggtattgttgcacctgcccgtgtgactgtgggcccgacctcccacatctgtgtctcccagagtcctggttcttcccctgctccatcctgttgcttcatcttaacagaggaaggaggaagaggtcttgggccattccccaagctcctcagggaggaaaaggcatgaaaaactaccgagttttccagggggctgcaagactgaaagggaaaaacttggcagactttgctgttccgttcttagccctcttctgctcagtgggcaattggggttgaattaggggcattctggatttgtggtttccaaggctttgcagccccccttcctagttggatatgacgaatcattactttttataactgtcgggggtgaaggggcagggcaggaaggctgtgtgcacccgtgtgtctggagagcttaaaagtggagcaggaattctctgggtggatgaggcagtgccttcttaatatgcacatcaccttcgctgtgttgtcatgattaacagtggagcctgagcgctggcgagcggtggcggaggccggcgggcagaagtgggatgtgtctttgcagcactatccattttcagagctgaaggaaatctgttctggggggagaggatcagtttggcaaggccacgttcaccccatgttccagaggactggagtgggtctggatcccgggcccatctcttcctctccaggcttgtctctcctgcaccagtagaggtcagggagagagaggggtgctgtctggactctccccgtggggcacaggattcctagcttctgtgccagcattaaagaaggctgggagatgggcatggtggcccatgcctgtagtcccacccgcttgggaggctgaggtgggaggattgcttgagctcaggagtttgaggccagcctggacaacatagcaagaccctgtctttaatttttttttaataaagagagctggctgtgcagggctgggatgtgacttagcggggcagcaggtaggatggaaggagccactcacagatgggaatctaataattagtctccaacttgagagagggtatagaaacatctttggaaaggaacagaatagatatgtgattcccacgatacagatcgtattgccatttccttggtcaagcccccaaatgttagtatccttccccttggcctggtggtcccatccccaccatcttgtgcatgaagtcctctagaaccacacccaggcctgcctttgggctgcataaatgccatcctcacggtccagaatccccttccttttcttctctgccaggagacacctgttcattctgcaagtcctgcctaaatgtgactgttctgtggtcactgctccctcactccccagtgcactggtatctctgcctctattaaagtgttgcaccctggtctcactggccagtctggagctctttagggaagggcagaatactgcttgttcacgtgtctccggcacttagctcagggtactgggacctagtgcccagttagagtgactgccagatagaggtgggctctgcacatatgttatggatattgggctgtgttcttgaaaagagtgccctgttgtatggatacatgtggaatacacggagaatctccagcaggaaagccctccttaagcatttagtggctggaggcaaagtcacgtctcatatcctggcccttcccaaccacagccattcgaggtggagccttttcctggctgagatgaccccagaggatctaattctttgtgaattcacaccacaggaaagggtccaaacggtttgaacctgccaaaagaactcaaggctgggattcaagctcccagaatatttgtgctggcaaacaaggggaagggcttcttccccagcattgtggcaagaatgaaactggggacaccatcagcaaggagggttgtgaccagccagctggacgtgagcgctgggttttgtgttccgatgatgcactatcactgtattcgggagcagtggccaagagaccagggctcattgattagtgagcatggagggtgttggtgtgacagccaaattcaggtgtgctgatgcctggccagtgctcattctgtttgtcctcaggggcataacatcttggctctgataattaatgccttaatgtcactatacttcagttttccccctttgtaaaatggggtcaacttttgcttcatttgtcttacaagagaaatgtgaggttaaaatcaaagtgtagcactgttttgtttttccttgagaattacagaagactccacttttttccctcttcagtcttgaggaccatcatctaactcaggggtctgcagactttttctgtgaagggacagctaggaaataatcttagactttgtgggccatcaggtctttgtaagcagccgtggacagaacatgagtgagtgtggctctgttccaacaaaactttatttgcactgtgttccaataaaactttatttacattgtgttctaattaaacttaatttataaaaacaggtggcaggctagtttgaccctgacttgactgtagctcagcctggtggctgtgctcttggggtccttgtgctgcagccaagaccagcctttgccctggtatgcagcttggtgcgagggacccagcctagactttgaagcaggttggacctggaaccaatgagatcacatctctgaggctcagtcttcccatctgtatcatggcagtcgcagtccaggcgctggagaaagaggcgctggcaagcagtgtgtggaggagctatgcgttaggttttggacgctgcctatacttttcgtttgccatgtttcctccctttgtttgggaaaccatcacttgctgattctgttccgccaggaggcaagtgagtttcatgcctggtgagcagagccttcactgagcgccccctgttcacgcctcagcagggctgtccagggaagccagattcctaatggtgcaaaccctgaacccttgctgtctgcccagtgctgccctggctccttggagagactgctaggaggaagggaggtcggctggggcctttgctcacacggaaatcaatgaaccatttgctcacctttgcaaggagtggaccttggtggctgtaaggatccctggtatttatgcagagatgagtatgaaggggagatgcagtacattcctgctttctctaactggtaacttccccaccgtcccaggaagatggtccacaccattgccagacctctaaacccagccctctccttgtcctctccccacaaagggccattgattgtcatgggctcttctgctgggtagccaggagccccacctgactgtgagctctcggggaccacgcagaagcccgggcagttattccactgctgtgtggcccagctcagccccctgaggacccacctaccgtgcatgtgccaggcccatgctgggtgtgcaggcgggcaacttagtcaccttctgccctcaagttggtgtctcagccccagctctggcctgtaaacacacacacacatacacaccctacataacacacacacacccacacccttcacacaacccctctccaagccatgccaagttcattcccatgggttgaaatgaagaaataacgtttccgccaaagactgcatgtaaaattgacttgctttcccttcctccccccatctggtcagcttccctttccttgggggctgtgggtgaggcagaccatggtgacagattccggatgtccatggcacctgagcacaccttgaccttctccccagactgagcttacgccattttctgtcggtatttgggaccaaggagcaaattggattgtctatcaagtgccttttgctgtgtataattattgtaattttgtattcactcaattaaagcaacacacctaacaggcagattacacaggccgccagtaccgcaggtcctctgcgtcccactgctggtcgagaaaacccactccttcagcctctccagagcagtggccggtgtcctaggagtcaggagggacgaggatgtgtggagtgttttatctcttaacaacctaaaacctcaagtcccctttcctcagcagccttctgtgaagacaaaaggcggatttggctgggtggtaatggcgtctgtctgggtagctgtcagcagtttacagagaactctcacagctttcgtgacccgtgagagaatcatagcctatactccccacctcgcttgagggatgctctgccaagacccagggcgacaaggccaggactccagccctagtgctttttgggttttgggaccagtgccttcagcacaggtcacagcctgtcctcacacttcgcctcccaggcatgcctctgaacccacagagccaggacttgagtctcagctttatttctcagcaagcccatgacttctagacaggtgtaggcagatttgaggaatatgggtggcatttggggaagaagcagtgagtttggggaatacttaacacatagcttattttctcctttaaaaaatcggtgtaggtttattttgttcttggtttggttttgttttgtttcgtttttttaggcaggtctcaccgtcacccaggctagagtgcagtggcatgatcacagctgactgcagcctccacctccctggctcaagggatcctcccacctctgtctcctgagtaactggggccacaggcgcacaccaccacacctggctagcttttgtatttttttgtagagacggagttttgccatactgcccaggctggtctcaaactcctgggctcaagcaatcctcctgcctcggcctcccaaaatgctggattacaggtgtaagccatgtgcccagcctgttcgttttgcttttgtttttgtttttgttttggttttggttttggttttaaggagctatcttccatccagctccaagaatctttagctcagaagaccaacttggtcacccttttggtactaacttttcttcctggttcctatgagccccaaggtgttagatgtgcctgccccggggcttgctgggtcttgccccttgcccatggcagtgtggtcgcctgctgcctcagccctgctgctctgtttgggccctgccccaaggtacctgtgggggtgagtggcctggcctggaggggtccacatggcacccccagacatggagtaaggaaaggttctgtgtttagagagcacttgaagggctggagcaggaaagccttcatgaaaaaggatatgtggccttcagcagacctggtgagatgaggccagacgtcaagctcctgctttccttgtaaagggcaggcgagtggccacaggagcaggaggatggggaccaggactggggaccccgtgtgcctcacactgccagctgtgccacagccctgcagtgtttgtggaatagtcctcatttcctttatgagggcagtgaggctcagagccgttgggaaactggactccgaatgaaccggaggagctgggattggatcccaggcccgcataatgtgggcgcttcctgtcacaccacaacccgcctctccaggacggcttcagatgaagtgcagggacttagccggagcgtgcgggagggctgggggtcctgctgatgcttctgaaatgcttttccgcagagtccttgaatccgttttacagtgggaatgctctgctccccacgctgtcagtgtgggtaaaggctttttcactaaccatcagtgtccacacttcggagttttcgtgaagtggcccagtgtttgcctcgatcacacccataacagagcctcctgggccctgcctaagtggctctcaggagctgctggatggaacactacccagtgctgaaattacaggagaaagaataacaagaaactgcgggagttagttgtctccactcagagatcttggggccagctgagatggaatagcgagtccattaacagggtccagggcagctggaaggctggacaggaagtgggcgtgtttcctgcctccttttcccagattcaggagtggggattttcccccatgttgaggtctaccccagggcttggtcctgctgccatcaccctgcagaggcagtgcagtgcagtggaaagagctctgacccgtcagtggaccccagttctcatcccagttccggttggctcatgggggtaccaggcctacatgctgtggccacactgggcctcagtttacctgtctgggagtgagagggaggtaggcatcaccctctcttggagcccctggcaggttaagccaacacttaagcttatttctctctgtgtaatcgtttttgtccttagcctggcagctcctcagggtcaggacaagtctgatgtgcctccagaccccagcatggggctggctggccacataggaggtcagcacccggcatctcggtgctctcccaagtccttcagccttgggttcattccactttgccctttgctttctgccctgacagatgacacggaggtgctgctcgcagtcttgtagaatgatgggctacccaggaccctgttagactctagaatcagacatcgaggcctggctccaccacgtaatagctatgcaatcctggagtgcctttatctttccaagcctcagttccttggcaataaaatggggcaattgatcccttactgcgaggagtccgggattagatgagcttatgtaggtagaggccacgctccctgttattgttactctcacggccccattccactgtcaagaaaatggaaatgcagtcaggggcagagccaggattcgaacccagttccttccaaaccctatttcttcatctaaaagagatgcaaatgggaatgtgatgttttgaggagagccctggggtagagttaggagatgtggttcagatgccaactagttttctgtggtcttggagaggtcacacctctgtcatgggcctctcttttctcctcccctgcaaatgttggaggaagggatgatagaatctgtcaaagccacctaacaggtgacccctgggcagatgccgttctccctaagcatctagtaaggacccccagccaccctagtctagcctgatattttgcacaccttcagggtgccatctgccctgatccaccgcatccctggaaggttaattaggcagcctctggaaccgaaggcatccagctctcatggagggagatgttctaaatggagctgggcctgctggccaagcagccctccagatgcacccattttgggttcctcaaaagcttccagcaagtggaagcctcaccagagatgtcctgcatggaaaagcacatcagtatcatcagctttgagactccctcctcctctcaccttccaccacagtccactctgcctgcctgctgggtctgttcagagttcggggaagagagcggcccccgtcccaccaaaggtcagagccctcaatctagatcctttttcattgttgtctgcctcctgtgtagccttttgcccgagtgggtaacaaatccaaaagagcacaaagtccgtcttcttcaaacctacctgtggatctcttgttgagaatgcaggctgggaaggaagacgagagcactttttgtggcctaataaaacacagggcagcagagcccctgactcctcatagagatgggcagctcatctgtcatgttccttgcagaagcaaatgcttccacaaacacggatctctgcccgtgagactgctaggctatgtggggttcctcctgtgatgccacagggtcttagggacacagcctagacacagggaacgtagtgacggagctccgggctgagtggaggtagcagagacacagaggagttctctgtggatgtggacgtgggtggcccgttgggaaatggcaggcgtctggctctgtgccgagaggtgggcaggcagagcctgtcagcgcttcactgcaggtgggagaggagctctgtgccctgaggaggtgggcactgagcttttagcttggcctctgtcaagaatgtggtatcatttttctccctgagtgactggcaggcctgggccaagattcctggtcctcatcattccaacccctagctccaagtcagagggaagacttctagctgctcttcccgccccagatttaacagcttgttccccatgagccagagaggttgtggggctgggctggggcctccctgaccagcctggctccatccttactgcttgtcagctttttttcttgaggcagctgcgccaagagcaagcttgtgccacctctgcttatccagggactggtctccagagtcccccaggggcgcttctgagggaggcgcagaggaggcacacctgccagccttgctgtctggatctcagcagaccccggttggagcactggtcctttgtaaaggctgccgtagattgaggccccaccgtgtgcgccacacgcccttgggtgcttcacttctgttttctctaatctgtcagtgagccagcctcctgccctccctgaccactgggcacacaggtgtgaggggcttgcccagagccccactgctcgccctgaggaagcactcagttaccaggaagggaaggacgcgagggaggaggcactcccttcttgccaagagccgaggaaccaacagaaggccttttgccccctcttggcaactggaccttacccttgaaccttcctcctctgttcttttcatatttctttttttgggggttggcttcaaattatcttgttttgtttacattacacccaagttacgtggtacaaaagacttgcaggtgcaaatatgtcccgccttcattaactcccctccctttttaatttatgtgatttcaattttccttccctgtactgttaattaggggaccctctaatcagtgccattatcacagtggtattcatgtttgggaaagccgctaaacaaatgcttgcaaaattgctaaatggctaattaatgtctgttaattaagaaaattgctcatggtaacaaaccatgccgttgctggcagccgctagaaagacacacacttgttgaaattagtagcgtggcaggtaggggaacatctgctcctcggagctttccggaagtgagcagctcctcgcttggccaagaaactcccaggcctcacagcggcggcgccctcgggttcttgtacagccccctgcgatgttctctgcacacctcttctctgtgggcccacgcccctcctccccagtgggcaggcggctggcagcctggctctgcaggagaaggccaagggggaaaccctacctaggcagctcctctctctttttaatttagccacactcaccccctgtgcacattttgaatttttctaaaaaccaacctctaaaaaacagcacagtcatgggtggggaagagcgaatggaggcctgtctcctcatccctggcatcagcatcccacgctgggtgggctggaacgtgcttccgaggcagccctccgcgcttactgactgtgacccatggtaggagagtcctttggtggtgtgacccagtctacacacacatgaatatttacacacaaaaccggggttcatgaaagacacctgccttaaaatacacaaagctctctgacttttttttttattacctcggatttttaagagataattattgcagcttgctgaattgctgagtgagtttctacccatagtttgtaaccccaaggttgaagtgaattcatctgcccatgtcttctggggcggggtaggggggtcgaggtcagcatagcccagggttgaggcggtgggggtgggggtcagcttggaactgaggtatgaaaaggatagcccacccagtcgcccagcagtccggggtccccacccttcatgcacttccccctgtccccagctctgcaccggaactcttgggtttcagggctggagatgggccttggacccatggggcttctcatcccagctctgccactgaccagttttatggccatggccaagttccttcatccctcgagacttagattcctcatcagtaaaaattggaatgagaaaccccgcctcacagggctgctttgaagtgcaggtgaattcacggtgtgcgagtctgtgctgcccacaccgtgtggccctcactcactgtcccctcactccctgtgtgttacatctgtggtgccccttgctcctcttgcctctgttgtttatctgtcggtgcccccggccctcctgcccccaggaaacccgtcgcctgggcctctccctgacacttgatcagtactgcctcgagtcacccatagccgtgtcactgtcccccagactgtgagctccttgagggcagggcccttcccgatctttccccacctcccgtgcaagcggcacctacgtgctttgcacctgggtccctgtgtctgtgcatcattgtactccctctgagcccgtctcaaccaacgtatttaacatggcaaactccgctccaagggtaggctgtgtccaggactgtactcccgtgtgctttgacagaggtgcttcattttttgttctttcaaccccctgtgaatgtatttatcagcttctctcgctcccgctcgccgttttacaccgttgagccggcgaccaaagcagcagctccaccacctcccaccaaccagagcccacccccccgcacgcccgccgcccacccttcgttttggtttaatttttgttcttttaagctgcttctgcgcttctccatgtgctgtgatctataacctgcctctactgtctggcctcacagggtcctccggggtcacagccctcgccgcacgcacagcctccacctcacaatcctagcagcatgatgggaccccacagtcaggtaaacgcaccgtggcgctcccgcccgccggggacgcggggcgcggaggaagcagagagcccgcagaggaaaaacaaaaatcaaaatgtgctctagccactgcctgcgagtctttattgacaaattaaatttttttagaaatttcttttttctaaagatagtcttcagtcctcggatatcacacccagcttggatacgaaaccaaaaggaaaaaatatatatttctgtgaccttgtcagctgcctttgcgtttttgttttttcctctctcacttttggtttggttttgagtttggttcaccatttgtttgtaaccgaagctgcatcccgagccttttctttgtgcactcgtgctgctgagaaagctttcctgccattcccctgcattaagttagggagcccgctgtctccttggcgtttcccccccagtccttgctcccctctctgtccctgctggtggtttctgtgtgcgtgtgcctgtgtgcgtgctcgtgtgtccagctttgtctgcaggcccttaagatgttacgtatcagtccttcttaccctttcatttgcccttaccgagagcagaggtttcctcctccgccctgcgttgatttaactgtttttcgtttcttatgcaaagtcccagccgctgcccttcccacccagagtagatctccacgaacaaatgtggagtcaagagacacatttgttgtgtggatctattgttccctctgcccaaaggaagttttgctgtcaaagggaagaggctagcaggagaaagaacttaaaagatcactagttataacaaaactggactttgtggagtggagagcatttgtgtttgtcactgtgcagtagggcaggctgtcattgaactaattacctataattgcagccttttatgtcaccgcgatacgcaggcggccccaggcccccgatcagaatgggaaaccaggtactgtaccttttcatgttctctctcccctccctcagccatccttggccctaggtggactttgacacaaaatgaaagttgagggaaaggattgaggggtggaggggcaggtttaacgtggctggtagcttactagctgttccccagagagggccccatgtccccgctgtgcccatggtgcggcagttcacctgcctctccagatggccctttggacagcccattccagagttcagaaggtggcagcagatggagctaaggcgcatctgggattgcagggtttcggctattctagagaagatggtaatgccctgcccctcccttctacccccttcttggaagagggtcttcctccttaatgaagctaattgacaatgtgcattttttcctggaagcttttgagaattgccaaggctggtaaatataatcctgctattagggggggaaatggcccgtaggaatgcttagatcaggagcctggatgcagcagagcaggagatttgtgagtttttcagcaatgtctgcctgcttcccagacccaactcaaaacaagaaaggatttgttcgtgtaattagaaaaggggtctgattacggggagggatttttgcctggggtcatatgccttacgctggcccattagggttggcaattctaggtggtctggagaaatcagaccccatgccaccctccctggttcagggcaggagaggagttgcagaggtaaatatgaatagatgcctcttttgaggatagacagacttaaaagaaacttttcgagaaacatcagggaaattttatgccccaattttttaaaacagaattatttcggtgactttgcaaaagcccttcaaaaaaatctgacagaagcgccagcacatccagcccttgttgcctttgaactgggagtttagtcaccagctaaattagcattgtctgagtgtgatgcttttcattctcagggctctgcaagaaggctcctgagtgaggtgatgcagggactatggagagatgctcattaccaggggtctccaattgtcttttttttttttttaaccggagtctcgctctgtctcccaggctggagtgcagtggtgcaatctctgctcactgcaacctccgtccgcctcctgggttcaagcagttctcctgcctcagccacccaagtaactgggattacaggtgtgcgccaccatgcccggctaatttttgtatttataatagagacaggctttcaccatgttggccagctggtctcaaactcctgacttcatgagatctgcctgccttggcctcccacagtgttgggattacaggcgtgagccaccgtgcctggccagctctccagctttaatgctaaattgcctatcgggttcccacctttttattttgtttttttttctctccaaaagtccttcattttctattttctctgacatgaaggggacaaatttggacaagaggaattagagacccagctttttgagcaaaagaagggatccctggatacatcacagatgaggaaacaaaaggtcagagtggaggagtgacttcccaaagtgagctgggctggagttgatcttggttccagcccagtgctaattgtactctactccacccctttcctcagttttcacagatgtaagattcctgcccccatctgtgtttttaacccatcaccgctgggcctgctttgccgtggcacataggggcgccagcagcagccttcccacccaggagctcttcttggtccaaactggcctctgccaggaagaaaggagctacttccttatcataattgtggtggcccttcttctggcaattaaaggatatggagaggggtgtgtatatttctactcagcaactaagcatgagcaaccactcaagagcaaatgggggataaatccatcatctgtactttgtattacacaccagttttcccaacctccctgccaaccacccccccccccgcccccccgcaatagaaatctacactggggctgggcgcagtgactcacgcttataatgctagcactttgggaggctcaggcgggtggatcacttgatcaggagttcgagactggcctggccaacatggtgaaaccctgtctctactaaaaatccaaaaattagccaggcatgctggcgtgtgcctgtaatcccagctacccaggaggctgaggcaggagaatcgctgggacctaggagtcggaggctgcagtgagccgagattgcgccattgcactccagcttgggtgacagagcgagactccgcctcaaaaaaaaagaagaaaaaagataaaaaaagaaatccacactggttttccagtttcctgtgacctcaagaaatttctatcctccaaagagggatgtgccccttccacaggtattgaccctggggctttcttgaagagtgccctcgttgggtctgccagttaacagaagccctgtgccacccgagttagctcagttctctcctgtgacgggtaaagggagccgagactagaggacttgctggggctcacaggccattatgaatgtgccttttgggtgaggggagtgaaaagggcccttagggaaacaagaagcaaagggtcagtgatgtggcctcagggtcttacgaggcctgcctcccatctgcctccctggctagaggctgtgcatagagagttgctgttttttcaagtgcgggtgattggatgggtggtgacagtggagttcagccgggtttaggagagagtggctggaatccagggttgtcagagagctctcccacacacatctcggcagaggtcccacctggcaggctggctgtgctggcggggcaggtgagagagcatgcggatgcagcagggatttgtccgtttcctgggcagatgcttcctgtgccttgccccacatgcagtgctgtaggagaagagctggcctccgtccagaagccccagagcaactcgctcccctgtaggccccaggggtgtgtgcacagcgtgtaattatggtcccatatatgagccgttgtttttcctccttaagtttgagggcttcagccctcttagtttgagacccctttccttggtcattgcacaccttcttcccctgatagaagaggcccagactgtctgtccctgtctcagggtcacctcagtgagggacgcgacctccaggtcccctctgagcctctgaacagcccagctttgctcctggagttccgacacataggagggttagaggaatccaaggaggagctttctccaagaattggtggtcagcattgggctacctggagagagtgactgccaagccccatggctgcactgtctgggttggatggggtggtcctgcactgggtgactcatgaccctgaaggtcccccatccacctccatgtcctgggatcccccagtccagacagccttagaggcaggccttcctgagtcaccaggactctataaaaaccacaaacccccagtgggcagacgcaaaccagccaagtgattcagagctagggaacctggggccaggaagcagggctgggagaaagtgagaggccggaacaactaaaaatccagggattggaaagacagacgctgagcacccccaggcagacggaaacagcaggtgctaaatgccactttgtaggccaggtgcggaggctcacacctgtaatcccagcattttgggaggctgaggcaggaggatcacttgagcctaggagtttgatacgagcccaggcaacatagtgagaccccatcaatacaaaaaatttaaaaattagccgggtgtgacagcgcgtgcctgtagtcccagctcttgggatggctgaggcaggaggattgcttgaacctgggagttcgaggctgcagtgagctgtgatcacactactgcattccaacctgggcaacagagcaagcgaccctgtcttaaaaaaaaaaaaaaacaaaaactaaaaaaaaaacaaaaacaaataccaattctacttcgtgaacatcagatactccctatgccctcacacaatcctctcgtaccttaaccacacatacccgctcccctgttccattctgaagctagggaaatcagtgaacagtctgtcccttcgctttccaccacctcgttccaaaaccggtttgaagttcactattgagctcaaggcaggagagctccccactcagcctcccccacagcagcacagcctgggctgggggcccttgaggacagacccctgtcacagatgcccagcctttgatcagcactgacacctgcagatgaggaaagatgaccagccaaaaggcttttcctctcgaaggcaaaagctcatatttataaagccctaagggatgaggtcctagaagcaaacttccccccagcaactcctactctctttttccagttgcagctgaaataacttcagtctcaagtaaattgcttttcatagggtttcacagcgggtggggcaagtgttcacccaggaaacccgtggcccccgtgtttaccttctcattagtaaccacaccagcaccgccgatggccccagctctggagccgggttctcgtctagtacccctgcccctctcctagtggccacctgtccctctcctagtggccacctgtcccgccccggggctgggtggcatttcctattgtagaagctgatgggatgtgacctgggtgctcacttggctctgcaacctgtgactgggagcccgcaggcctgtgacctcagtttccccatctcaatcctaaaagcctcctcatcctcttttcccctttaaatggggcttcccacagcgataggattttaggtagtgggtgtctcagtccccgtaatttggaagtagagctaaaatgaggtatgtgtctgtgagacaaaggcaagatggggtttgggcagaaggagggagtgggcactgctgcctctgagaggaaggtggttggtgctacagccagagcaagacctagagaacttggtctcctgcctcacttcagagctctgataggtacacagaccccctaccccaagacagcaggatgaggcggtggtttccctcccacagagcccccaaaacaacgccacagttatagctaacaccacttccagctgactggtaggcccggggtaaccttctcccactggcaggcagcagaagtctcagggaggccatgagtggctccacgtgatcacacggggcactgggtgggacaggtagatgcctgtccccatggccagcagctccggagcagctcctcagcttgtgtcttgcatctctttcagcctccgggaggagttcctgggacacagccattgctgcccaattctatggatcccacacgacaacaaggtagagagggcagggtgggcctagggtggctggggatgccaggaggggctcctcctccctccactcctgccatcccatgacgcgcctcctctctcacgcaggccaccccaacatgggaggatcaatgcagagaatgaaccctccccgaggcatggggcccatgggtcccggcccacaggtaaccaccgcctgtctgtccgtccgtctccctggccatctgtgtgcacccgccttctctcctgtttccatgctctgtcagtctcccacatctctcagttcgcaggggtgagaggaagggcatggccgcatcccctgctcctgtccgcttcctgtggcaggctggcttcacgcgctgcccagggcagccccttgcagatggcaggcagagttgagggcccccaccagggagctaggaaaaaggggacagctgaggccttctagttggcagacccttttggggtgcggtagcctatcatggggtctgaagaagggcagggagctcctgaaccccagagctgcctcccctgggtgaggtagacttgagatggcttagggccaccatcggttgtgtcccagaggcggcgcagatgagtggccttcctagctctgcctgcgacttagcatgtgtctgtccttggatgaatcactttgacctctgtgggccccagcaggcctcagtttccccacctgttaaatgaggactgtgtccgcgattctctggtgggagggggccacgctggcaggaccccagcacccacttcagccgggattctttgaccagagggctccgctgccacaaagggcagtttataagccattggaagaaagcatttcaggtgccctcacatacctcttacggtcacaacaaagtcgttgcccctcgtggccagctctgctcccccaggtaggggtgtccaagcaacaggtgttggcgctgacaggtgttctgctgtggaaccatctcactgcttacccccagccctctgggtgtttgcacgtggttctgtttcctatagtagccgtggcagagcgttcgcgatgttccaccttgggaattctctagcccctaactaaaggaagctggaagtctgaataaggcaaggggcttgttctcaggtgttctttcccttcttttctgttctgcctggagtctgctgcactggtcactcccttggttgcgtgcaggtgttcaggctctgggccccctgcactggtttctgggtcccctgagggtggagtagtgcccccccccattcccgcccacacgtgctcccttttgtagggagaggcgtctgccccacagaaccacagccctctgctccatcccagaatccgccccacagaaccacagccctctgctccatcccagaatccgccccacagaaccacagccctctgctccatcccagaattgtatttacagcaagcccaagccaccgctttcttctctgtggtggttggaacatctgtggtgttgaaagattttagggaggtccttgtcttctgccagccccataatcctaaaaggaagcaagcccacagcagttgcagctccaatattctggttgtgttccttcctcaaatcctccaaagttcgcgtttctgctagctccttttaagctgccagagtggccccttcctgcctggcagccgcctggagctgacctctgcagggctgcctgcctagggaagggggcaaggggcagagtaggagcggagcttcccctctcctgagtcagatacagctctccctccccacagcctaagccacacagcagtcacattttattggtgtagaaatcagcagtggccttggattgtcagatgtcatgggatctgtgtgactcaggaggatggaatctgaggagggaaaatcgaatgccaccgcccagcccatggatcctcagaggctcagcggctgcatctgtaaaatgggaataagaactgtgcctgacctggagggctgttggaaggggcagggtccagtgtccagttccctttttttttttcttttaacaggaatcaaattttatttttattttttaaaagttaaaatattttttattaaaagtttttttaaattttttaaaaaataaaaaaagttttattgttttttattctttattttatttttttgagggtttactctgtcacccaggctggagtgcagtggcatcatctctgctcaccacatcctcagtctcccaagtagctgggactacaggctcccaccaccacgcctggctaatttttgtatttttagtagagacagggtcttgccatgttgcccagactggtcttgaactcctgggctcaagtgatcccccgacctcagcctcccaaagtgctgggattataggcgtgagccaccgtgcctggccaggtcaagttctcaatgtgatgctggccacagggtgctcccgctaaggaggctatttgtgttttccaactttagggactgaaaaccaatgttaagacctctagttgcttgggtttggtgattgcttttaatttcttcttctttctctttttctggcaaagtcattaacagtttgttaggaccatcgtaacactgagattctaaaggctgggaacagatgtcaggctatttgagagcagcagggtgtgctggcagttcaggacttcctctgggtgtggtggatgtctcatcatgtctgcccctgacccgtagtccagcacactctttggcacactttaaagaagtgagggtcccagcggctgaggccctgcagtgagactctcctggcctcacccaagcagtgtacaaggggtagagctccccttagaccctaggagtgtctccagcgggagggagagaggctcacccgtctttatttatgttacacacccttgccaacctcaggaactctggaagcatatctcctgctctttattttactttatcaatgtggagaccctaaagtgcttcacccatgtttcctatactcctctgggtagggtgagtattaaatcccagagccaaacgtcccttgaagaaacccagggtgtctgcactggcccatcactggggtcaggaaagcctggcattgatgtagcactgggcccagacaaggttgatggtgcaggatggattacagggtctgtggtcacctacgggctcatcttgggcccggcagagcctggtggtttgggactctgaggtggagggtagggagagggcagactctccctgttccctaggccatttctgtctctcccctgaggatgatgccctgtggacaggacagggacaagcccagaacttagttctggaaagcacagtcctgacagcagctcagcctggctgggcctccagtctgtcatctgcaaaacgggcagcaagtgatggcctcatggggctactggagggtgggcgaaatagcagctgtgaaatgttacttgaagtccccacatggtgtcctgtggatcccttccccttcccgcaggccctgagcttgtgggagggagccctgcctactgccacagcccgggctgtcaggaagggcggccagccccttcagcataaagtaagcaccacaacacacacagtgctgtgctgagaccaggctcaaaggtgggagaccatcggcatgtgattcacagccgggaattagattgcttttagccagtgaccactccagaactttctgaacaaagaataggtacagcgtggtcggtcatagggctactttatttcaaaaccgaagggagtgacattgcattttgtgagtctgtgtcacatgtcagcctaaatgtctcacaggaaccagcaacgcaggtatcaccctgtcctttgtcatcagtgcttcagacagattttactctggttttgtaaagtgccagtgccagaaaggagatagtacttccacttagaactcttctttctaaaaagttttatgtatgtcagtatcaggtagtaacgtcttatcctagtgtttcaaaagtgaattctaataggacgaagctaaaactgaggggctcctggttggacttagtagagagaatgccagcccccaccagaagtgcggtggctcccagaccccggggtgccaattctgagagccaccgacttgttgttgtttctggtattcaggctggggctggagccaggacagagtagaatcaggtcattatcctggtttgtctgcatttgagagttcagatgaaggagaatccacagcccctgggacaatcctatgccacccccatctcctggggctgatccagggccagtccaagctcagtgccactgagcagaggcccccaaaagagatgggtgggtcattaatcctggtcctgagcaccccgagctggtgaggaaggaaaagggccccttgaggaactttctctggtggtcctgcatgagatggccaggcccctgctgcccagaaaatggctgggacagcctcaaatccactctggtaggtgagtcctaaagactaggagagctatcccctaagggaaatacagcactgtgtgtattcccttcccacctgcctcctgcaagatgcttggctaagaatgcagactctgggggccagcagatccaggtttaaacagtgggcacctagaaagcccttctgaggatgtggcaggagggagcagcagccaccgcctccaggctgcagccccagacagctgctcggtcccttctcactgtggacctggcggagtgcaaagctgagacagtggcccctgtgaatgtggccagccccacggctgcactggaggctcctgctctctgcccagctgtccctgcccctgcagagcggtgccagtggcagagggatacctggttggtaaccgacccttgtacagcttcaccgtcatcacctccagccacgtggtgctgcaggcaggcaggcaggagctggccaaagagggaacccgtttctactgagtctgaacttctgggcattcctgccctatgtgagaaaacttcgctgcaaaccagatttcagcctgctactcgctcctgacatctgtgtggccttgggcatgtctctggctttctgggccttcaagttgtcatctatgaaatgatgaggtgcaagtggctctccagggtctgtgcctctataggcggcaggactggtggagaagctccctctaggaagctgccatgccggttcttggagaggctcctgaaggccaggcagggtcaggagcggcaggatagtgcacttggagcctcccagctcagcgctgcgtactgcatgtcaagagggctctatggagtgagcacctgcttatcatctcctctcaccccactccgtgctgagacataccaggcttctgctcttgttctgagatgcaggcctttctcttggatgggagaggcggctgcagtcctggaaaagaactccatctggaagacctctctagtcagctgggctgtacacacagtggagaataggcctggggaggtggcaagctgcttgtcctggagcagcaggtggggagatgaggctgagatttgtagaggggattagaaagggccctttgagacccaagcttctgcaatgctgcggtagcattaagggctttggtgtttgttctgctgctgacgtcccaaatcagtgcacacctcctagggcttacggggcacttcagaaccattgtttcatttgatccactggagacctgcaaggttggaaacacatggggctctttgtccccattttatagacaaggcagcacagcagaggggattgtgggtctaaagccagagccatgctgcagggcttcaccccagctcagccacgcacaactgcacagtggggtcattcttcctctctacctcagttttctggtctctaaagtgggtggaggaaaggggtcattgtgacgatttattgtaggcagtgcacacacagtctgtggtacatgtgggcatggaataagcactattgtcatttggtaatttgcccaaagtcaccagcaggcagccaagccaaggccagccttcctgtgttctgacctcaggtctcgagttctgctcttcaccctgtggtagagtgggcttggccccagcacattcccacaaggctgccactgtttgcttgaagcccatgccctgagcagccacagggtgaggcggggcctgccttctctggctccgggtctggctctttgtcagccagcctggtgttgctcctgagatcatctgcatcctgtctggacatccttccagactccaagcctctctgtggctgagcaagcggagcaggtggccccagggtggtgagatttggaagatgatccctggatgcagaacccactatcagcccaatattggctctgtgtgtgtcaggctccaggtctccatcttcccattctgtcccccttcccacccgcctcccgccagtttcttggctaagcatacagaatctggggggccggcagatccaggcttaaatcctagctgtccatttgctcactgcaacttgaggcaaaactttctccctcagaccttcagtctccttttctgggagactgaagtgggaacaatcccagcctcctggagttttcacacagatcaaacaagagactgtacataaagtgtgtcatgcactcagtaaagggcagtgaatgctggctgttcctttgccatcaaaattccagcaacctacttcaagttctcctacaagggcagagcttaagctgcagccaggctccctttggtcttcatgcattcccttcttcggtctttcattgattgcttcagtgccagcgtagtgagtgccagtctgtgccactgggtgcatggggtggggggtatatgatcatcaagacacagccccaccttcaaagggcacttggagtccactaggagagatgggagatggacagacacgtggccatgatcagacccagtgtagcatggtggcgggggagggaggttagaaggcattgtgggagtaacagggctggagcagtcagcccgaaggggtggggtcaggagggcttcctagaggagctgctcttggagctgagtaggagcctgccaagcagggagcagggaagcaaggcatgtatgactgcagggaaaatgacacttggagagagggtcacgagcaacactggcctggttatataggaagagatgcgcgtgatacgaggcctggtgccttgacccaccccgctgtgcctcagtgggccgtcctgagctgaatctggactgctgggacttcgtgagttctgtgtagacttttctctcaaacattggctgggcacagtggctcacgcctgtaatcctgatactttcggaggctgaagtgggaggatcacttgagcccaggagttcgagaccagcctgggcaatgaagggagaccccatctctacaaaaaaatttaaaaattagctgggcaggctgggtgcggtggctcacacctgtaatcccagcactttgggaggccaaggtgggtggatcctgaggtaaggagttcgagaccagcctggccaacatggtgaaaccccgtctctactaaaaatacaaatatcagcccgacatggtcgtgggcgcctataatcccagctacttgggaggctgagtaatgagaatcgcttgaacctgggaggtggaggttgcagtgaaccgagatcatgccactgctctcctgcctgggcaacaagagtgagacttcatctccaaaaaaaaaaaaatcatcgaaaattagttgggcatggtggtgcatgactgtagtcccaactacatgagaggctcaggtgggaggattgcttgagcccaggaggtcaaggctgcagtgagttatgattgcactactgcactctagcctaggcaacagagcaagacgctatctcaacaaacaaaacaaaaaaaaactcacacacacatagtgatgatccctgagtgcagaaatggagttttctccggcttcccagcatcatgtctgtggagggcctctgatgctgacacatgggtggggtaggactaccacctggacctggggcaggttggcgtgtctgtatgtgccaggcctgggcctgcaccagcctcgggcaggcttctcaggagtgcctgctcccatccacattgacactcacccctcgcctccctgcctcctcacctcagagcctctcaatgggttccaagaccaagtccatcccctcttacccgcctgagcccagggggaaggtacaggatgacatcatgggagcccagagagggcagcggcttgctggatagccacatgtttttgagaacttcatcttgaaagctcctgaaaatgcactgaatgttgtgactgtccctctgtgctggcttgtcattgtggtccctgtgacttggttcccacccgccccaccgtttttgaaagaatgtattattttttctcatcaatccttttcacagactaaccctctcactatgttttgtctgtttgtttctcctccctcctcctgtctccggttcccttcttctcatagactgacccttggttatcgttgcagaattacggcagcggcatgagaccaccacccaactccctcggccccgccatgcccgggattaacatgtaaggcaaaaacgacccggcccgtggctcagagtccaggtcttcccccaccctctgccagcaccctgggagactcatgataaggggtcattgctggtacctctctggacctcagtctcctcatcggtaatgtgaggatattgatgatcctggtgatgagagctcagcctcatagagtgcctctgtgtgccgggcacggttcaggcatgctgcgtgcatcagctcacctcatcttcatgattaccctatgacgcgatgatttttatttttatttttattttttttgagacagagtcacattctgttgtccaggctggagtacagtggcacaatcttggcttactgcaatctccgcctcccgggttcaagcgattctcctgcctcagcctcctgagtagctggtgttacaggctcccgccaacatgcctggccaatttttgtatttttagtagagacggggtttcaccatgttggccagggtggtctcgaactcctgacctcaaatgatctgcccgcctcagcctcccacagtgctaggattacaggtgtgagccaccgtgcccggcctgacgcggttattattataacccccttacagatgaggtcaccaaggcacagagaggtgaagtaacttgcccaggctcacacagctttcagtggcagggtcaagagttgaacctctggacagtgtagccactgttctctagtgcatttgtgatttttaaccctgttgtgagaatgtggactcccttcctaggaaaatgcacatgcaaagggaatttcacatattttttatctaattttatatactttgtaaagtttacctataatttaaagcaattcatagatttccacccatgaagttacccattactgccctgagccagaaggctctaaaccgcagggctgtaggaaggacttcctgttgtgatttcagccctttccttctgcccctgctgcctccaccgcttggagtttacagcgcctttttcattgtccacatctctttctccctctctcaggggcccgggagctggcagaccctggcccaatcctaacagtgctaactcagtgagtacctgggtcgggtggggtggtgtttgtcaggggagcggttctgggtgcaggggagctactgtccctgggtgtaggtgtcacgggaagtgggagatgcagcaggactctcctgatgcttctagggagaaggccgtgtggaggtggaggcctgggagtaatgtgcaggggtcatcaagggctccacccctgccctgcctgcccagccagcccactcctctaaggagtaagctgagaacctgggctcagagagcactgttcagagtggagacctctacccatctcctccccagcagggctggaaggtgcgggtaaggtgctccacacagacagtggggtgaaggccagaggaatgtggggtaaagctgtttcctgccctctcaaaccggagggccttctatgtcctccctgtgtctgtggctccctcccaggactggggagtaagagaccagggtctcagggtcagttcaatgtagcagagagaactgggcttcagccacgtcccagccctcccaggggaaccaagtgggtggccagctcactgggtggcgatgcctttcctgtgaagagtgggtcgtgtcctcagggaggtttggcagctgagggcactcagtgactctgacgtggggctccctgacatcttgtttttagattccatactcctcctcatcacctggtacctatgtggtaagtgtgtgggtttggggcattgcatgtctagccacgtgggactgagtgtgcaagagaactggtctggggtccccgtttctttccctttcacacattcttctgagcagaggttccaaactgctagaacttgctgtcaatattcagtcatctgtacagacccaaggtggcccagaaatccccaaaccagacctgggggtggaattgccttctggggagctgaccagtgggctgcttggcgtccaccgcaggcctctctagtgggcatgcctgtgagcacataatgcaggcacacacacccacaggggccgcttggtctgaagaaagggacaggggacatccaggtccccttctcaagcttgagtactttgagtgagcgctgggggtgtagcaagatgaatagcggctgggcctggggcgagcagttgctgctgaccagggagggaggatgccggcccctccccatgttcgttaccaccgtgggtgtctgatgtcagttttgtctcatctttagggaccccctggtggtggcggtcctccaggaacacccattatgcccagtcccgcaggtaagagcgcttgaggggaaagtggggggtctggtggtggagggtggggcatgttgccagagagacctggaggggcactgttgcagagccagagcttaccagccactccttcctgggcagcacatcttccactgggcatttagagggcagggggtcccttgatgacactaacctactcctctgatgctgctccataaaggacagggctgagcagagcagtccaggaacagggattctcgttgcctttgaatcccttttgttgggaagaaccctgttcagggtgggcatttccccaaatgactcaaaaaggggccttggggttctgccatcctgggaccaggattctgaggcatgctacctttggagtttccgtagctcctggcttctggtcctctatataggagatcccttctcccccccgcccccccccccttttttttttcttttttgaggtagaatcttgctgtcacccaggctggagtgcaatggcgtaatctcagctcactgcaatctccacctcccaggctcaagcgattctcctgtctcagcctcccaagtagctgggattacaggcacgcaccaccatgcccggctaatttttgtatttttagtagagatggggtttcaccatgtacccaggctggccttgaactcctgacctcaggtgatccacccgcctcagcctcccaaagtgctgggattacaggcatgagccaccacacccagccctccctgtttctttaaacaaaagagggcatgcgtgcacatacgtgggcatgtgttgcgcgcgcgcgcgcacgcacacgcgcgcgcgcgcacacacacacacacacacacacacacacacacacacacaccccatcacaattatgtttctttcccagctaagaatagcataccagccagctagaaggaattcaacatacgatccttacccaccccaaaaataaaaagtgagaggtagctggatttctgcccaagaattacagcgcctgctcctgatagaaacgttttagctggagacttttttggctaactggggagatggaggggactctcccccgccccctcctcggctccccatagcagggaagctgctcagctgcaggggtggagctggccgcagccgggatcctgggctcccactccggctctctctttctgctgctgcattttgatgagctgcatgacctacattccgactgggccacatgcacccactccatatgtgaatgcgtttccagccccatccctgcctctccctcctgccccatcagcctggcagggtggcctctgggtaatttgccacgtttccctttccctgatttgattaaaaccactttgtagggtggtgggagagcacaggtggtgggaggagagcacaggtggtggttctgctgcccccatgttgtcccaggcagtgtctggggaccagattcggtgtggggtggggagacaagaatttgaacccgtaatccccctgtgccgtgtccacactgctggggttgagtggttttcacagttgaattttctgtgattaaaaactttgtgaatcttcattaaatacaaattagccagaaaatggtggtacttagaggaaattttaggttataaaatacaaaagaatgagttccagtgccatgagtttgttttaattaagaaacgaattaatcaccccgacttgtgggtttccactgttctacagattcaacaaattccagtgacaacatctacacaatgattaatccagtgccgcctggaggcagccggtccaacgtaagtctgctttctaataatttacatatcagacaccataacaaatcataattaacttcatcagctgaggggaaagcaagtttaattgatttcagccatttgttaccaaagatgaataaaataaaccgtcagaaaagtgattaactcttgggcaactcagttcccatttcatgggcggcagggggtgggagaggaaggggtgggacgatgcccaccctctggttagagccagggtgcccgctgtgctgctgggacttgccacctcctgccgtgctggtgggggaagcgccatgctgtaggtggggtctggcctggtctctgcccagcaaactggctgtggcccgggcaatccctctcctcctgggtctgtttctggggctatggagttgagggtggagccagcagcaaggggacagggctcgctgggggacccgcctgcctgtgctgctgccaggagctctggaactcccaatacctggcagcttctttgcctctcagagttgcagcccttgggtgatgttgcagctcacatttccccatttctgattactgcttgccccacttcctcctgtgtcccctgcacccactggatgggacttggttagtcagctgcagcctgtctcctcacccagggggcgttgcccgaggtcggggcctgatctgcttcccctccacaggcaacccttccattctagttccttcccttcctcctccatgcaggcctcaggtgaacctgttcagccttgcccctccaggagctcagggtctgaaaaggaggtctacagactgtagagccagagagtgggcctggggccctaaagtgcgaggctttggcctggttgagggggtagggccttttggggcactctggttttgttggctccgttcctgaggtgacacccggatcaccccacgtgttaaaccccgagcgcgggctgccctgtgctggatattgcctacatccagcagccctctgagggatggtttctggcctgcctccgttgccagggtcctcactggtgtgaccaaccatctggcttttaacactaaaaagccccacatcctgaggaatcccaggacacagaaagtcctgggttttgtcagtgatgcagaaggttgggtggaaagtatgaaacccacacagagggatgacagcaccatttgtagcatcggatggaaatggcgtggatgatctgcctcgagtggtcactgtcgccatgttgcctgacgtggatgctggcatcaggacttgtgattcaccatggatcacatcactcaggctgcaactccgcacgctgcagtcatgcatgttagcagcacttgcctaggagtctgctgcagattcagtgttgggctttttgtctagacggtgctggtttcagtcttgacatcatgaatattgtgactgtatttcctaagagttcagatgatgaaaatgagaacggtgacaatgacagcaccagcgtgacccaggcatcactgggaaagaaggttaaatgaccatgttactttaatgacagatgcaaggacacacacaactggattagggaggaaagaacccaaacagaatgtactgcgcggtgtgcagaaaagaatgtgagaaatggcatatggagaaggggaggtggaggcacattggacattgagtctctcaagtctgaggcatatctttctaaatcaaggtttttttgacctccaaagagacagcagttctcagtcaaaaacagtggtcgcagaattagcttgggcgcactccttgaatggacgccattatcatcttgttcccttgattgcaccgcaaaccaagaaggttacatttcctgattcggaggttacaaactaaaagtcctgtgtgtgaaccaaaggacgagggactttcagtaacagatgcattgcccctttacagtagtgctgaccctgtctgatccttccagcattcgtgcttccgagtgcgtcaagggctgcctgaagtcatggctacaggtttccgctagctcttaggtatgttgatttgaaaactggagtttcagatcgtcttctcgatttctgtgaagattttagtgaagccactgaagacgtaagagattgttgttctcttgtccaaatacaacctagactttgctcatttatctacatatttggcagacagtacacagttaatttgagcaaatttcatttagtccataagcttcttaccaatgaaaatgaaaacatcttacctgctaaatgttcacacctcgtacccgacactgtcacaaaggggtgtaatttgcttacctgtgataccagctttcataatgaaagttttgggtcacctttcggtttcctcaaaacatgccaaagcacttaatgagatctttgactttatagacaggagaatgcctcagacacgtttccacaagatgactatcattgctggccatagaaaagatgttaaaatgttggcttgccatgaaaactgctattttttaaagtgtgagacaagaaggatgtccttctctaatttggaaatgcattgagatgagaatggaaaaaggaattacaataaaatacaggccaggcacgttggcttacgcctgtaacccgagcactttgggaggccaaggtgggaggatcacttaaagccacaaattcaagaccaacctgggtaacaaagcaagacatcctcaccatctctgcaacaaaaaaataaaaataaaaaatacataggctgggcgcggtgactcacacctgtaatcccagcactttaggaggccgaggtgatcagatcacttggggtccgtcgggagttaaagaccagcctggcaaacatagtaaaacaccatatctactaaaaaatacaaacattagctaggtgtggtggtacatgtctgtagtcccagccactcgggaggctgaggcaggagaatcgcttgagcctgggaggtggaggttgcagtgagccgagatcacaccactgcactccagcctgggtgacagaatgagactccgtttcaaagaaaaaaaaaatacataaacacattaaaaataaaatagaaatgtatatactgttttgccagtactctctgatgctccttaaggagccccgaggagcctagatggggctagccagccacacttggattggagagggggccacaaaacctcatacagcaggaataatgacccatttaatgcttgagaactcaaaaaatgtcaccagaaaaggcagtcaagttaaacaggactttatcaatttcttcattaaaactataacatatttggaatccaacttggattttgcaacttcagattacctctgtgctttaaaatcattttttataacaattttaatttataacatccattgtgctttggagtgttaaaaaatgatggacatctggccgggcacggtggctcatgcctgtaatccgagcacgttgggaggccgaggtgagaggatcacttgaggtcaggagttccagcctgaccaacatggtgaaaccccgtctctactaaaaatacgaaaattagccaggcgtggtggctggtgcctgtaatcccagctactcaggaggctgaggcagaattgcttgaacccgggaggcggaggttgcagtgagctgagattgcaacgctgcgctccagcctgggtgacagagtgagactccatctcaaaaaaaaaaaaaaaaaaaaaaaaatcagccgggcatggtggtacacgcctatagtcccagctactcaggaggctgagtcaggagaatcgcttgaacctgggaggtggaggttgcagtgagcagagatcgtgccattgcactccagcctgggcagcagagtgagactctgtctcaaaaaaaaaaaaaaaaaaaaaaaaaactggacatcttagacagggatagcccatctgatgaattacagatgcaaaggcctgattgacaagcagctggtcctccaaagccagcccctggacaaaaatggatggacatctttggagagatggacgtgaattcctacaagtcccaaaacctgtgcttataagtaaaaccggaggtactttgtgtataagggttgtgtggagaggatatttagtttggtggtaccgtgttaggtgacactaggagtcagtgtaacatgggctttgaataaacagagtgacaagtcaaatggattttaagtttgactatattccgttttaccagtgcatttaaaagaaaggtgttctaagctgggtacagtggtgtatgcctgtagtcagctactcgggaggctgaagcgggaggattgtttgagcttaggaatttaaggctgcagtgagccatgatcatgccactgcactccagcctggatgacagagccagactccatctctttttttttttttcttttataaaaaggatgtcctaaaggctataaaggcttcaggcaattcagagaccagtgggaaagaaagcagagcagaatgttctaatgtatcctagggcagaaagaaacattgttattttttatttaaatattagtaatgtttgtttcattaatcctattatgtttgtttgtttgtctgtttagagatagggtgtctgtcacccagtctagagggcagtgtcacagtcatggctcactgcagcttcagcatctggggctgaagggattcctcccaccacagcttcctgagtagctgggactacaggcacgtgccaccacacccggctaattttatttgttgttgtagagatgaggtctcactatgttgcccctaatttattttttattttttatttttatttattttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggagtggtgacgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtgcagaacaaaatgaaaagtctcccatgtctactttctacacagacacggcaaccatccgatttctcaatcttttccccacctttcccgcctttctattccacaaagccgccattgtcatcctggcccgttctcagtgagctgttgggcacacctcccagacggggtggtggccgggcagaggcgcccctcacctcccggacagggcggctggccgggcagggggctgacccccccacctccctcccggacggggcagctggctgggcggggggctgacccccccacctccctcccagacggggcggctggccgggcagaggggctcctcacttcccagtaggggcggccgggcagaggcgcccctcacctcccggacggggcggctggccgggcagggggctgacccccccacctccctccccgacggggcggctggccgggcggggggcttaccccccccacctccctcccggacggggcggctggccgggcggggggctgaccccccacctccctcccagacggtgtggctgccagccggagacgctcctcacttcccagatggggtggctgccgggcggagaggctcctcacttctcagacggggcagctgccgggcagaggggctcctcacttctcagacggggcggccgggcagagacgctcctcacctcccagacggggtcgcggccgggcagaggcgctcctcacatcccagatggggtcgcggccgggcagaggcgctcctcacatcccagatggggcagcggggcagaggcgctccccacatctcagacgatgggtggccgggcagagacgctcctcacttcctagatgtgatggcggccgggaagaggcgctcctcacttcctagatgggatggcggccgggcggagacgctcctcactttccagagtgggcagccaggcagaggggctcctcacatcccagacgatgggtggccaggcagagacactcctcacttcccagacgggtggcggccgggcagaggctgcaatctcggcactttgggaggccaaggcaggcggctgggaggtggaggttgtagcgagccgagatcacgccactgcactccagcctgggcaccgttgagcactgagtgaacgagactccgtctgcaatcccggcacctcgggaggccaaggctggcggatcactcgcggttaggggctggagacggcccggccaacacagcgaaaccccgtctccaccaaaaccagtcaggcgtggcggcgcgtgcctgcaatcgcaggcactcggcaggctgaggcaggagaatcaggcagggaggttgcagtgagctgagatggcagcagtacagtccagcttcggctccgcatgagagggagaccgtggaaagagagggagaccgtggggagagggagagggcccctaatttatttgttgatgtagagatgaggtctcactatgttgcccaggttgtttttgcactcctgggctcaggtgatcctcctgcctcagcctcccaaagggattacaggtgcgagccaccatgcttggcctatgttttattttaaaaaaacataaataataagccaggtgcagtggctcgagcctgtagtcccagctattcaggaggctgaggcaggtggatcacttgagtgcactctagcttgggtgacagagcaagacctcatctctaaaaaataattaatgtaatatagcctatcaaatttaagtattcgagcaaaaagttatttctgtatcagaggacagaaacgttataaaaatattaatatttttcctcatacatatcaatcatttaactagtccacctcctaattgctactaattgccgctgttaacagttcctattgttgtttacataatagcattaatctaatggaaaagtaaataatacagaataaatgatgctgagacaactgaatatccacatgtggacaaatgagattgaactgtgtccttacagcagtacacaaaagttaaagtagatcatagggggccgggcatggtggctcacacctataatcctagcactttgggaggccgaaacaggtggatcatttgaggtcaggagtttgagaccagcttggccaatgtggtgaaaccctgtctctactaaaaatacaaaattagccaggtgtggtggcgcgcacctgtagtcccagctacctgggaggctgacgcatgagaatcgcttgaacccaggaggcggaggttgcagtgagccaagatcacgccactgcactccagcctggccgacagagtgagaacccgtctcaaaaataaattaaaaaataataaaaaataaaacaaagtagaccatagatctaaatgttagagctgaaactacaaaacacttgaagtaaatacaggagtaaatcttcatgacctgagttaagcaaagccttcttagatgcaagaccaaaagcacaagtagcaaaagaaaaaagtagacaaactggacttcatcggagattaagatttgtgcttcaaaggacaccatcaaggaagtaaaaagacaaaccacagaatggagaaaataaatcatgtgtctgataagggacttgaattcaaaatacataaagaactcttagaaaaactcagtaataacccaatttaaaaatgggacaaggatctaaatggacatttctccaaaaattacaaatagccagtaagcacatgagaagatgctcagcatcgttagtcattaggaaatgcaaatcaaaaccacagtgagatggcacttcacacccactaggacggctgtagtaaaaaagataatgactggtgttggcgagggtgtggaagcattggaactctcagacactgctcgtgggaatgtaaaatggcacagctgctttgttaaacagtttgacgtttcctcgaaagatcagacagcctagtgatgtctgctgtgatatggtaattgggttaccctatgacccagcagttctcctcctaggtatctgcccaagagaaatgaaaacgtatgtccacacggcagacatgagtgtcattacatcagtgtcattagtcataatagtcagacagtgaaaataacctgaacgttccttctgctgatgaatggataaatgaaatgtggtatatccatacggtggactactttttgaccataggaaggaataaagtactgattgatgtgacaacactgatgaaccttgaaaacatgctaagtgaaagaaaccagccacaaaagctcacgtgattctatgtatatgacatgtccaggataggcaaatccatggacagaaagtagattagtgtttgcctggggccgggggcgttggaggaggacagaaatgactgcagtcgggtacaggatttctttctgaggttatggaaacgttcaaaattggttgtggtgatggttgcacaaccctgtaaatatactgaaaaccactgaattgtacttaaatgggtcagttatatgctctgtgaattatatctcaataaaacttaatatacagaaagtatacaataatatgtcattttgaagaaatacttgtttcttaatacattgatgttaaagtagcgacatattcatgttaaggtaatgacatacatgtgcataaatctgtattatcatgtttggggattttgggggtctggcatggctgtgtcctgggttggctccctagaaagctggttactttcatcctcctatcacttaggttaataagcatgaaattggttgctagatggcaaaatgtgcccaaaagcctgtgagctgctttggtggggggcccactggagaggcaaggatgcgccacccctcccccagtctgggtgggcacggggaagcagctcataccctagctgtgcccctgcagcctggtcacagccttaccccttacacccctttctgtgctctggcacgccatgctgccacccacttggtagccttctgctcatgtgggacccctgccttagagtgatttccgcgatgggctctgcctgcccagattttacccctcaattttgttgatgctctcttcctcctccaggcagccggttctgatttctctgccttgctctgaagccgcagctgtactttgcagctgtctttggaagtcagcatctctgtcctcctgtggggtagttgggtatccgtgagctgctcctctgggctggggctcaggtgtgactcagctctgcgtctgtggcacccagtcccggccaggtgccaaacagccctccattccaccacctccactcccttcccactcgatgcagatgcagtctgcatcacagggccttggcgctccaggctgggctcagccgcccctccccagccccgtgactcgtggctgtgggatgtgacctttctggtcttcctttccgagaagggtttgatagttccagataggcttgtgggtgggtagaatcgactcttatctccaagccctcatctgccacaccaacagttctgcatgggagcctcatcagtgacctcctgccaccaccccacagtcccagggtgccatgcagtgcctccagggccagtgccctagctctctcttccccaccactcatcaaaccccacctcttctcaccgcccagccccaggaaacatcttcatttctaatttcttccttttgttaacttgggagagggccagcatgacagctccaggcctgctgccaggttccagtcccagctcctccacctccagcctctgggacctcaagcaaagcgtttcctctcactgcttctgtttcctcacctgtgaagtggggatgagaagcacagatgttttggtccctggcctgacatggtcggagagctgtccacatgtgcctctgtctggggaaccacactctccacacgggggatggagagggccctgtggtgggatccgagaggctcagtttcagaggtgcctctgtgtggagttgggtggcagtgggccagtccctctccctcacctgggtcattggaatgagcacctctgccctgcagcttagagggccgaggtgaggaccctggcccagctgccaggcaggacatgtccgagtgtgagcagagcctgccggagcaggggttccccagggccaggactcaagcgtggctgcagccccctgcctgtgaggggtgcagagggccagggcccgctgagctgccatgccctgtgcttcttccccagttcccgatgggtcccggctcggacggtccgatgggcggcatgggtggcatggagccacaccacatgaatggatcattaggtgagtggcccctgccctcgccatgccccaccctgcctgggcagccagctctgtgcctcagctcctggctcagctgggcttggtacagagccctggccggccttggctgggcacacaggacgatcctgagagggatgccgcacagaaagccctccgcacagtgtgggactgggatggaagggcttagaggcccgaggagcccaggacgaggggagacccctccgtggaagagcaagcaagaaactgaattggattattttttctttccagggtcaggcgacatagacggacttccaaaagtgagtgtgcactcggtctccctggcggcgccccatctgtgtgggcaggttgttggggacacaggtgctcacctcctctcctctttccacagaattctcctaacaacataagtggcattagcaatcctccaggcacccctcgagatgacggcgagctaggagggaacttcctccactcctttcagaacgacaatgtaagcctcgccccctgcctgttgctctcgtccccacggcctggggactctttcctaacaagttgcgagctacggagccgggctgcagcctgccagctaagctggtggccgtgttatggtttttccacctcagttatttttttagcagaagtgtgcagccttgacgctgccctgagactgcctgctggtggggccttctggaggcagctccatgcaggctggatgcctctggcactgattaagctgatacggccgggagagccctgggctgagagagttggggcagtattgccccacgggtccatttccatctgtccagtggggaaaggttcgtgcagccaacgattttcagggctctcaacacgggttggctgtctgcttttctatagtgggcttctgtgtgcattctcatttgaagaaacagtgttatgattaagcagctttcaagaaccccagactgccagcctgggcaacatggtgaaacctcatctctacataaaaatacaaaaattagccgggtgtagtgtcgcatgcctatagtcccagctacttgggaggctaaggtgggaggattgcttgagcccaggaggttgaggctgctgtaagccttgatcgcaccactgcactccagcctgagtgacagagtgagaccttgtctcaaaaagaaaaacagaaaagaatcccagactggccccaccccagggcaccctggctgtgctctggctcatcaaagcccagttccctgcagtctggaggcctgcactgggcaaggggcaggggctgtgactgccattggagaggagaggatgactcagacaggggcaggagcaggggaggcgccgtcagctgccttagttcccaacagaagggcaggctggcactgagaagtggctcttagctcccgcctcctggcccttatcctgccctaccggccccctgcccactccatgccaccatgtgcccctcagctcaaccacatccccaaatgagccctgctcagttctgtgcagtcaccccaggctcttggcacctgggtgtgtcagcggcctccccacaatcctcaccccccccccttctctgcttctcctttccagtattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaaaggcagtcaccgttttccacttggggttttggtttgtgcaacaggcaggggaggagtggggacgcgtttgttctagcttgatttccatggcaacagcagcggcacgcttggaccccagaacccagcaccctcatcctgtggccagaggggccggaccactgacccctttcaggattccaccacagcccagaccgtcaccgtgacccggtggcatgcactgttcccaggacaccctcctcctctcctggacctcccttccgtcctggcctccctgcctctccagcccctcctctgcccccaccccagtcttcccagtgagaatcctgccagctgggtggtggcctggcgcagagtgggagaggctgccactgacaggatggctatgacctgggacatggaaacagtgacctccgcgttctggtcccgagatcctcgcatcagcgtcatcgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacaccgacaaccaaacagacgtgctggctccagtcctgtttttactttcaaaaaccaacaagcccgacagtggagcctgtcccctcccgggagggtgctcatggccccactcacctcatcaccccacggaaacctttgtgtcttgccctggaagacacccgaattctttgtacattgacatgcccttctccttcctccctcccctgtagctggtctttgttttactccctccctttctgatccatgtatatcatattatgtgagatatcatctgcctgaaaaaagactttgtgcggattattgggaacattgtagctgtttctgtgttttttcttaccttgtagtctggttctgaattaagagaggaaaaaaaagtaattatgatacattgtagtttgtgtacgatatatgttgataacgttttattaaagggacatcttttttccgcagcccttcctgacatgtttggggaatgtgggttggagtttattacactgattacaaaatgcaaggtgacttcttgggcacagtttttgttcctggtgcataacaagatgttttgtgtttgaggcgtctgccttcttttcctgggcctgcaaattctgtgttcttgtggagtcgcgatggccttggcggaaggtgggttgggagggaaggtatccatctcactttaaatatttgggggccgtctaaaagccattttccatttcttgtcttgcaaacacattttggtccgctggaatgtcttttatttttctggaagtagaaaaaggttcctcctggtgccctctgttttctatggggagtcgctatcggccaggagggccacagccactccctgctttctcccctcgggtgggactggcttcaccccaggcccccagcctcaagtgcctgctgttggcgactgttggcacagggaggttgatttttttttttcctaaacctccaaggtgtactgggagcccttgaagggttttgagagtagtgcagtctacttaaattttggaaagtgtatgctggtggtctcctgggagatgaatcaggtggggctggcaagatatggagagaggcattcccagacgacatttaggcaagaaatgctgagggctagggtgaggtaagctgctatggatgctgacttgcacgactagaaagaactttgtacttccctggagctctggggacctcattctaggcttgtagcaggagcggatgccgtggtgggtgggtgggagacagagggtccaagcaaagggcaggctcagcccatgtttataaagcccttaggggaccagatagcaaattcccaggtttaaatcttgtttgctgcaacttgctgtgtggccttgggcaaattagttgatacttctgttctcagttctctcatctgcaaaatgggggatggcgggttggctgcctcataggctgtgaggaggttagcaccgtgaagtgcttagaacagtgccgtgcacggactaagagcagcatgtgttcgctacaagtgatgttactcgtggggagagtccaaatgggtgtgttggggagtagctgggaggatctaggagattccatctggtccttccctcttcaccttggaacaaggtttcctaggcttttgctgagtacagacacctttgaactattggaaaagcatctccattggagagatgaagagactgaggctgcgactaacctgtatcaatggtgctgacccagggctggggaaaggaggttgggtggatgggatatccatccgatacctgtgctccttggagcaggagtcaggcacagacgagagccatgggatcagggtgcctagctggaggaaggcaggtcacggggcccagcctgggaagagcgcctgctgtgtgctgtgctacccctcagcctggggcccctcggcagcctggcagttgccttcacaacacaaatggccctggtgcaggttagtttggccttcctcaggggcagatctctgagcaaagaactggttcttgttcactaagcattttcatcactgcctggggccaggccagagctctacatgagccagtggaaagatactgaaatgaggaggagaaaagggagcatcatgccagtccttccacaaaatagggcttcggcccatcactgagaggtgccggagtcgggggccagaccacagctttcctgctggagtcatcgctgtccacaggcacttgattctaggggtcggccggcctggggggccagaggtaggaccaggcctgagacaggaccccacacctgcctccctgctgggcatccccactgccccctgccccagagccaggaaagaaacttaaggcaagtcgctgacaccagcagcagcatagccactaacgcgctaggccagagcagggctctagcgggggtaagaaggctgctcagtctggctccctggtgacctgaggaatcccccgccccagtctcggctgtcccatgaagtggtgggctgtgttcccagattccacagactccaggagattgagcccagaacatacctggggtccctcagagggctctgaccctgaactgaggggagctgggcctcttggggttcaggccatggggctcccctggacttgagcagagtggctgggcagggtggggttacaggcggatgagcgttgctctgcccagccctgggctcactgggtacaagcactgggggcttggagttggggctgggggttggatgtaaaagatcagaccaacgagggtgggtgctgaaaggcagaggttgtgttctctctattcccagggtgcctgcggagccgcagaacctggcatctggtttctggaattcagccatgcccttggtttcctgcctcccatgtcagccctccagtgccacaaagaccatctcactttgagcctccatagacttccttctttccatccatccactcgtgtttgctgagcaccccttttatgccaggggttgttctggcactaggggtacagtagtgaacagacacggaaggacagagatgccgtttgtggaggtgaggcaagctgcaggaagagctctgttctggcgagttaaatttgagatgctgatttgatatccagtaaagacatcaagtaggcaggtctgaactacagacataccatgggagttgttgccatttagagggtctttaaagccaccagactggctgaaatcatctagggaatgaatggagaagaggccgaaggactgggccctgagatctggggaataggagggacccacaaaggcgacagagcagtgagtagaagaccaggaaagtgagatgccctggtgaccacgagaagaaaaggggtgcagagaggagagggcttcttgctagtggggaacccaggtggccacgcccaccgtgactctgggaccaagtccacgctcctcacagcttccagatagctgcagggcatggaagggccatggacactcctgcttttccttgcccctcagcacttcacctccaactttgcagtactctgtggatgtctgcccccccagggcctttgttcctgctggcccctcctccttcccacttgcccttcagaacctagctcagatggcccctcctcctggaagccttccaggctggggtagctctctccctgggtccccacagcctggttcagtgtatgcttcccccatcaggctgggagctcctctaagccagggaccatgtaagagccctcttcgtcctgagaattgccagcacaggtcctggtgcccagtaggtgctcgatgagtgctcttggaataactggatgttgttgagtagccccagaatgtgctcagtggcacccctccctatggcaagctgtcacctgtgggtgggtaggcgcccaggtgtggggaaggaggtggcctttgtgggtacctgctactgccaatccaaaggagaccactctggccgtgtccacccagtaccccaggagctcccagagggcggggaccatgtctccctcattctgtaactcgctcccagcacaacacctggtacacagtaggtgcttattaaatgggctgcccccaaaggaggtctacggtgagggacctcagggctcaatctccagtctggacctattcttgggttccatcattggcctagctggggaggaggagatccatgggtctcgtgtacacgtgtgtgtgtgtgcacatgtctgagtgtgtggtgtgtgggtgggagtgtgactgcatgtgtgggagtgtgatgtgcctgtatgcatgtgtgcgcgcatgtatgcctgtgcacgtgtgtgagagtgaacatggcaggggccatgttgctctgacaagctggcctctaagggatggaggtcctgccctgggcagcacgcccccctggatgcagtttttggatatgaggagatgtattctgaggggagagggtccctggatcgggggtcttccagcagtgaagcaggtaggccttatgggtcatggacatctgagtgtccatgttaaagagagagtcaagacaatcgggtcacctgcatgctttctgagactttcacccacagcaaaagaggaaccagggagatgctgtctaaagcccgagaggatcctgtcctgctcctgtgggttgtcacagagcctctgccaaacacttgccccaggtccagcctgagccagctttgggagagaacagagagcagcctaaagtgaggtcccctccagcaagtccacctttccacctggcttctaagaagaactccaaacccatcgacttgaaaccttggcgaatggagcctatttgatccaaaggtggggaaacttggaagggaggtgctgtatccccattttgccagcgaggaagtggaggatctgacagggcagctggaatacaggaggggaaaagtggctttcccccaggccaaattagaattcccttgccactgaagcttgctggaaatgaactgaagaacttttgaatggaacaaccaggaatttaaatatatgagacagtgagaaatacgttcacaatgggaatgtcaccatttcatttccaaaagtctgctgctggaagttcctctcgtggggtttcgctatccagcatgacccggcgcagcactctccctgcagcgtgctcctgctccttcaccagctcactggctggggagcctgtactgggcgggaggctggctgaggccctcaagttccgctgcatcacttcctctcctgcgttgaatgagggagtgaggacgaagctggtagacatttgggatttggagaagcaaggacctgtctgtggagggggcagctgtcatgacacacgagcttcccagctcttcacactgcatcatgtggtctctaagcctgtttcctcatctccatggggacaataaaaaaaaccgccagtcctgcctgccccactttgcagatcagctgtactttgcagctcccttgacacaaaagtgtagttgggttccaggctccacaacttagcactaaggccagcatccgagctgccctcattcagggtgggttgggaggacaggctgcccaggcctgcccggcaaccctggcccccttccaggcagtcctcaagctacaaggtcatctgctgatggtccgcttactcagagcctccgtcccactcgctcagggctcaagttcacctcaccctccctcctctccaagcagtctccaggggcttcagcctgctcaggatcacgccaagccatcaccaccacttgccccaggatccccgcagtggcctccagctggactccctaccgccatcccaccagctcctcctctgtactcccaacagagtgttgtttaaaaaaaaaaacgtttgactcagcaattccactgctaggaacttacccaatggctctgctggcaaaactactctaagatacatgaacgagggtgctcactgcagcattatttctaataacaactggaaacaacccggactgccatcaacagatactaatgtggctgctcaaaagaacgaagagatcctatgtggtgatgtggcaagagcctacaatccagagacatcaggtgaaaaaggaagtgcagaacaggctgtaaataggatgactcttcagtcatgtatatatgtgtgttgttatgatacatacacattttcaccaacagcatggaagaaacttgaagctctgttaaccttagagaaaaggactagctagggatcaccttgggtgggtcgacttatctttccctgaactctgaacttttatcatttatgtataattgtttcctgtctgtaaaataaaaagtaaaatgggcagcagggctcagagtacccggagccccaggtcagctgccctaggaggtgaggtgcttggtgttcaggcccctcccaagctggccactccagccccagccaagcctccggcctccccacttccagtcacttcctgtccccatggtcctctgtgccttgctgcttttcctgctaatccctcaagcctaaaaagtaagctttcaagtggaaagagcccaagcctgggaggcagagacacaggctggacgccactttgccactgcctagctgagagctcctccagctgctggaagttcccacactaactgctctcagcagtccctcagcaggaattacagaccaacaaagccacctcgcccaaggtcccacccgctgtcaggaagcagcacatatccaatggctggtgccaggccaggggtgtttgtagaaggctcaactcccttgcctctggctccagagtgcccatgaactgggtgaggcctcagaggcagccacactgagcttgggcccgccacccccacctgctgctgccttcgctctccacaggttcctgtcctaaaggttctccccaaataaaagtctctaagtgtttcctcgggaagctgacctatagcaccaggtgggtgaccgtgggcaaattccttaaattatccgtgttttcttcttagggcccagaacagtgcatggcacatgctaggcatgcaatatttttcttgaatatggaaatgacatttaccttgtaaggggtgtgtgcagattaaatatgctatgtatcaggtgcttggcatggcagcagtgtctggcacagatcaggacttgacattatttggacagagaccagctgaaccaggggtgtacttgccccattaaccaggatacgagggagaaatctacaataaatatgctagcgagattttctgcagtcattgtggaatgtgtccacaatttaaataatgccataagaacctagtgaccatcagcgtatctgccatgtggcagacactacacacacataacccagagtcttcaacgccaggtaagtcacattagccccaggtttcagatgaagaaatggaaagagacagatgaagatccttatctaagatcacaacatgggtcaagggcagagctgggcttcagctggggcaggtcaggctccagggcttggacttgtgtgggcgcccttcccgatggcaccctcataccaaacacaggcttcagtgcaacgcaagggctctttattgtcagcgagagcagcaggccaaacgggcactgaggctccacggggcccaggccctcttccgtggaagagaggcaagaggggtttcaggattcagaggggtcctccgctcacgcagcaccatgcaaatatagagctaaaaactttctgaatgtctctggcttgaaaccaactgggccaacaggttcctggaaagaacacggttcattaggatcctgctactaggtttaacggcagcaattaaaacaaagattggattgaagtaaatcttcagtgcctggacagtaactttctttttctgacatcgtctctctctcggactaagaaggggcattgaggggctgtagcctgggaggacaggaagcattcccagcccccttcagccaaaacaactgttgacgctgctctgctcccgaggccctctcacttccaccaccaggaatgatggttgaaatgggctgctgccctctctaatcccagggacaatcatccctcacccattccacacacatttattgggcacctgcttgctttctgctgcgcctatatcctgtgctggaaacagacacagcagtaacttgactctggttcctgtcctcaaggagcttaccgtcagctgttcaaatagtgaaaatgaaaggagacagaccccactgcagaagtaggaaaaagaagaaagcaggaagaaatgactgacttgccgacatttatacatggaagggtgagcagaatggggcagaaagaaaaagaaaaggaaggagacttcagaaagcccagcacatgcaatagaagaagtagaaatgaaggcaggaagggcaagatcgggctggagcccagggcgaatgctgaggggtggagcggcaggagatgaggctgcagaggtgaggagaagctgtctccaaaccacaacaggcccagccctgagtcagtatcctggaagggagaggctgagggaagagaacctgaagacacagagtcaggagggaaaacctgactaagagcagagagcacggaggtggctggtgtgactatgcaggtgaactgagggtgtctggggccaaagcaaagggcacagacccagcaggcatttcaggtggaaacagcactgagagctgctggagaaccagttcaagaacggacctgctgagaatgttcaaaggctcagcgactccatttagcaagcccacactcaggcctgtgtggggcctggttggtcccagagcaggcagtacccctactccgctttcgcagtcctgaccctgctgtaggtctctccagggtgcatattactgcctgatgctctatcaggaatttatttagatactgctactgcccactacacagagagcaggcctggaccccgtcagctgagcagtggggtgcagcacaatggtgccgcaggaggaactccgtatctgtgggatgaaacgaatgcatccccagaccctgccctcaaggatctaggagcttggagttctgtttggtggaggaaaaaaaacatgtgaagaggttctacgcacagcaatgtgatcgtgctctgatgggggaatacggaggccagggcagcccacctgaggcacttaagtgagggttgggatggggacggtggtggtcagaagtttcccaaaataagaaacacttatgctaaacctggaaggacaagtggaggatagcctgacaaacagtaatggggaggggagaaggcaagaagcctcccagacaaaaggagcagcacctacaaaggccagagctaatgaagccgcagagcaccctgggagctgcgaggagctggattggctggagggtgcaaagggaagcaggagctggagtggagcactgggcagggccttaggtaggggcgggactgaaggagtcctccaggcagagatcccgggtgggaagtccccagggccagggctctcctcacagagcaccccagcaatcccacctgaggctcacaccaggtaggaggaggcatggccctcctgggtcaggcaggagatggctcaacttaccacaaccactctctttttgatcactgggagacaccaaaaatgctgatagaggagctggtctgagtccacccaggccaaattcttgacaccctcgttacagtccaggtctgtggtattcagttgaaacactaggaaatggaagacacgtccatccgtgcccacgctctgcaccaccacgggctgctccaagaccttggcatcattctgagaggaaaaggggacaaggaaaacaaatcagaagctgtggagtgtaaggaacagcacggcccaggcagcttctagttcttccctttacaacgtccacctacgtccactgaatggcttctctttgggacaattaaaatagaatgaggagttcagggcactgtccagggccgggccttccttcacccaggctggctgtgcctcatggccccagggtgcctgctcttctatttgagcacatcaaagtaatagttcctgccactgagaggcgatttccaggcaagccagagttcaggcaggccagctggggggttaatgacagaaatccctcaaactcctggcgttacttgataaggaccacagtgacatcagctatcaaatgtgaatccggagggtcaacggatagatataatctcattcagttctcaccccatttgacagatgaggaaactgagactcagtgaggtaaagtgacttgccggaagtcacgaagatgggtggtgtagaacccaaacaggctcatgccagaccacacccttcccccacgcccctgccttgcttctaagggcctggcagtcacattcactgggcttcatgctgacgctgcaactcagcacgggccatgtttctggagtatccactccagccatgccagcgccaggatttcaccagtcaactcctgctactgatctcttctagttactgccacttggtaatagtagtaacacctaaaatcatttactgaaggcctctcaggtgccaggcatcttgccagttttacatcaggtcacctctactctcataaatctagaggtatattcccactaacagataaggaaactgaggttcagagaggtggtataatttgctccaggtcacccatggggatcagactccatgctattaagtcactgaaagccctgttgttctggtttaatcctggtgtcccagtgtatctaatagcggcacctcattattctcaatggtgtcccagtttgggagataaatcatatggtgacctgctgagactttgcagcaatccagtttggtgactgctactcactgaacaaagatccaacaggcaggccccatgaagcaggccatccttgattcaaaaatgctgcctgtgttcaccccactggggctgaatctggcattaggaatacctaatgtcagacctcagtgtgggccacactggggctgttggccttagaaatacctgttcttagctgcatgaaaaataaataaaaagaaaagtacctgtaagtgttagccgagaattctgtattgactcttatctccctctacagatcaataaaactgcaggtagtacataaatttctcagcaattttaccttttacatggaggctcttcccataattgctcaacttcacatccccaggaataatttgtgcctggaggggctgaaggaggcctccactcctacccaactgggtggtaattagttgtatcgttgctacccagactctgatggcaatagctggcacagaggctacagcgagtctgcaggcctgggaccagggttgtgactatctctgcctccttctcctgcctgagttgggagtagcacatccttcaaaactggagagatcatgttccaagctttgcttccccactcattagctgtgggatcttggacaagttacctaatctttcggagccttcaggaagtatatagtcagagaatgggaataaagacaattgtcctaggattggaaagacacaaggtcacataaagatctgacagctactaatttcttagctgtgtatccttgggcaagttccttagcctccctgagcctcagtttcaccatctataaaatgaagctaatagcatctgccacatggggttaaaaaactacaaggattaaataatgccatgttctgaaatttcagttcagtggttgccttttcttttttcttttttttcctttgaggcacagtctcactctgtcacccaggctggagtgtagtggtgcaatctttcagctcactgcagcctccgcctcctgggttaaagcaacattcatgcctcagcctcccgagtagctgggattacacgtgcatgccaccacacccagctaatctttgtatttttagtagagatggggtttcgccatgttggccaggctggtctcgaactcctggcctcaagtaatcctcccaccttggcctcccaaagtgctgggattacaggtatgcaccatcacacccagctaatctttgtgtttttagtagagatggggttttgccatgttggccaggctggtctcgaactcctggcctcaagtgatcctcctacctcggcttcccaaagtgctgggattacaggcgtgagccaccgcacccggccagttcagtggtttttaaactcgagcttgtagcagcataactggggggcttgttaaaacgctgatcgctgggccccaaccccagggtttctgattcagcaggtctggggtaggtctgagagtatgccttttcaacaagttcccagatgatgcttctgctgctaatccaagactatattttacgaacgaaccactgatttttttttttaataaaaaccctaaataaatgtgtggtatgcagcaggtgctcaatctgggcaaggcccattccactccctatccatttggctaaccatggctctccaactccccctaggccaaataagatgggaaacagtacttttcctcattcctcctctagaaaagactcaggctctaaccaagacctgggggtccagcagtggctctcatgaactaccccccaacacaccccaaaccagggatctggtgtcccaggcctgcttgagggctcccatatagccctcccctccctggaggcctttgctcccagagccaggctttccccatcttgggacagctctctgtgacaagttagtttgtattctataccatctaggtccctgaaacctcctcttaggatcaggggataacaccaacgagtatcttgggtccccagcacccatcctgagttggcaggcagggcttggccatctctattgctccacttcctcctgcctgtgctccacttctgccactacaagaacagaggcagcatgctgcagcacaaacaactgaagacttcagagtggggcagacctagctgcagtcctatctccaccacttagtgctgtgtaatgctgataagctgcatggcctccctgtaattctatggcatagcttagaaagtggggacttcagtaaaaacatgtgggctactgtgatcaagtgagctacttaggtgaagcacaggcagtcaccccctagtgatgttggctcatctccacagggtgggctgaagtactcctccctaaaactcctcagtcaagaaatcagttcccctatatcccttttcttcctctgagcagtaaccttaagggaggagaccaacaccacgtaaagcaactcagtggtcttctccacctacataccccatagaggagccgggcctgagccagggcactgccaaaagcaaacaggatcatcttggcccgcagctgatctggttgaaggcggtgtggtcgtaaattggctttgtccagtaagtacagggtatggggataggggtaaggatagccttcctggaatcctgcaagagacacaattatgtggaggggtggaaaggattcatcagcctgccacaaagcctcaggaaagtcacctcgccttagcccagggacaggtgctacagagagactcaacaaaggtggatactatcactatagctcgggggctggcaaacttcagcttgctggccaaatctggcctgctacctatttttgtaaataacattttctctggagcacaaccacattcactcatttacgtatgactattgggtagctgtgacagagaccatatgtggcctgtaacacctaaaatatttactgttttgactcttcacagaaaatgcctgccaacctgttataggtgctgcctgcaagctagttctaactccacacctttctctctcattctggcacacagatgacagtgatgttaggagaaggagaacttgaaatctgtggtaattattcaaaagaaagcaagtcatttgcaaaatttactactttaatattagtgacaaatgacttgcctcatcattcacaactgacccacacaacactggtgctgagaatcaaagtttagtacttgttcttttcagccatgaccttgtcaagtcatgattctcttctcccgcatggctacgagtaactcttggtaggctgggaacttctagaataagtgatctggatcactgaatataggtgaaaagaagaaagaaagacgtcgggaaggctgggcatggtggctcatgccggtaatcccagcactttgggaggctgaggcaagcagatcgcctgggcccaggagttttagaccagcctagaaaacataataagaccctatctctaaaaagaatacaaaaattagccaggtgtggtagcacatgcctgtggtcccggctactcaggaggctgaggtaggaggattgcttgagcctgggaggtcaaggctgcagtgagcaacaattgtgctacttcactccagcctgagtgacagactgagagaccctgtctcagggaaagaaaaaaaaaagaggctaggaaaataatgtaggctctgaaaagcctagaggaggcatggctctcctgcatgtttggtccttcagcctgctcaggtattcggcacaggtaaatatctagaactcactctgtgccaagctgtaagacaggtaccaggaatggaggccaagcagagcctgccactgcctttgaggagctcacagtttagaggggagacagacaggaaaactgaccatatctgtatggagggacatgtcaagatgtgaggtaagtcaggggctgtgggaggacagccggaaggaccctgatgagactggaagatcccaaagcatttctgagagaaagtcattcctaagatgaactgtgaaagatgacaagttagcaagctgaagaccaaaagggaagaatggccaagagcttcagcagaaggagaggaagtgacaaggcatggaggtgagagagggcatgatgaatttagcacagtcacaagaaacagggcaggcaggggaggaggcaaagatgaggctggggatggggcagagaccagatgtgaaggccctttcacgataagcaaaggagttccaactttaccaacaggccacggggaggtgggcatgaagacagatgggatgaaagtggtgttggggaaaggctactctggaattatgaactagatggaccagagagaaaatagtgtggggtcagacagaccagctgggaggctgtggcaataggctaggtaaggacagtaaagactgacctaggttgtggctatgacaatgaaggggtttatgaggaagatgctacagctcatgaggacacagtggatggcaggaagtgggggccagcctagtctcactcccttgtgatgtcttgcctgacggagtacatggtggtcccttgcttgatggagtttggattaatggccccattcaatgtctatggggcttcctcagttcctaaagggggttggccagagtttacaaggtaaacagaaaatgggtgcctttcatgggacctatgaataaagaaaaagccttggtgaaaagcccctcaaacgcccaatgatacagtttgctgaagaaaaaaaaaagtccctcaagccactctgatgtaatagagttacttctccaaggtaaaaagtaaagttagtctttgagcaaatcacttaacttccctgagctgcagtttctttgcctatgaaatggagataatagtacttgtctcatggggctgccacatggatcctaggagataggtaatacacacgaggtgcctagcacctagcaagttcttagtatatcctttccctccagaaaaagcatgtccttctcctccacactgcctaaaagtccaagacattgatccttacctgtgtcatttttcacatcataaatattgcattcatgaagatcgatgatgggtgatatggggtagaaggtctctagaacatgattcttagtagcttcaatctcctctctggaggcgatggtgggcagaggatccttagtgctcagtcgggctccaccagaaccacggacttgaaggagaagagactctaaaagggagaaaaatggttactctaacctggtactaaaggctttcgcagctaggcgcagtagctcatgcctataatcccagcactttgggaggccaaggcaggtggatcattggaagccaggagttctaggtcagcctgggcaacatgacaaagccccatctctactaaaaaatacaaaaaattggccaggcatggtaggctcacgcctgtaatcccagcactttgggaggctgaggcgggtggatcacgaggtcaggatatcaagaccatcctggctaacgcggtgaaacccagtctctactaaaaacacaaaaaattagccgggcatggtggctggcacctgtagtcccagctactcgggaggctgaggcgggagaatggcatgaacctgggaggcggagcttgcagtgagctgagatgacggcactgcactccagcctgggtgacagagtgaaactgtctcaaaaaacttaaaaaaaaaaaaaaaaaaaattaaagactttctcaatcctgcaaagtctaaagccttcatcctcccatgtgcctcaagtcatttatagcatttcttgatcagcctaatcacagaacacaaaactttgagttaggatgttaatcctgggatccctaagaggggatgaaccaatgcactcttcttcctgtgttcccttcctagtaaaccctgagggctgatggtctctggggagcgaagcctgccccatccagatcttcctgagcacctgctgtaacctggggaaccagagatgtgtgagagttactctctcctctcaaggagcccaccaggtagtgagtgctacagtgaaaaggatgaaacatattcaaaaattgtacaggtggggaaaactgaacttctctgggaatgggaagttccctgaaagaagcaatgccttaaaatgacatctggaaggatggataagagcagagattctcaactgcagcactattcacatttggatcagataactctttggcggagtggggggagggaatgtcctgtgtactgtgggatgtttagcagcatcctggcttctacttactagatgccattttaactccctccccatcccaactccccacaccccatccacatcatgtcaaagatgtctccacacactgccaaatgttctccagagggaaaaactgtccctagttgaaaaccactgggtaagagcttgccaggcaaagaaagggggaaaagcactctagttaaggaggaataatgtgcaaaagtcaggtgcaggcaactccgtggcagaatttaaggagagaaatccaggtgactagagtaggatacagcagggaagaagtgatggagagagagaggagcactgagactagagttagagaggagattctttttttttttttttttttttgagacggagtcttgctctgtcgcccaggctggagtgcagtggcgcaatctcagctcactgcaagctccgccttccgggttcacgccattctcccgcctcagcctcccgagtagctgggactatgggtgcccatcaccatgcccggctaatttttttgtttttgtatttttagtagagaccgggtttcaccgtgatagccaggatggtcttgatctcctgacctcatgatccacccaccttggcctcccaaagtgctgggattacaggaatgagccaccgcacccagccaaggcagaggagattcttaaacttaggaaaggggccagattgtccttaacaactgagagtgagaaaaccctagccagtcaaacagcctcactgaagtcggattagcatatatgctacatgcagacgtaggtgacaagaggaaaacaaactcacatctgactcatcagcaagccagccattgtgaacatgcatagatgcccttcacagaggtccccacaggaggtcacatgctaccaccagacaaaatgtgcctggaaaaacaccttgagaatggcctcctgaggagtatccacggaggcaaatctttctcagaaggtgcttgggttttcagaaatagccacagtgtgatggtaatggatcaaggccggttttcttgtatgtctaagaattggtttggtcaacagcactgtcattaattagcatgtggcctcccttactggataggtaagaaagggatactacatctgggggtggataaactctgatctgtcacacctcaagaatagttttctaaagtatttcctgtttcctcacatataatctgcaagaaaaataaatgtgcatggacctctcttaaccttgggttttccattctccccacagaccactcttgtgtggtttctgattcaattccctccatatccctcctccagtgacagctccaaatggggtagtttaattagaggtaatacttgatgatgggccaagtactcctctattaatgaggttcactaatttccttagtggtgtcattacctctgcaaagctgactcattgccaggaagtctatacacaaatcctgaccaagcagatgtcctgaaatcccagatcattccgtagctggttttcctgctccaggattccaccagttagaacacctgtgttctctgaacatccctgcctgaaacaccaacagtaggtatatgcatttacacatcccttcagtcagcacctactgtgtaccatgaactgttagacactgtggacaatgtgagtaagatatggtcccagccattaggagttcagttgagtggggtagacagaaccgacagtagatactgacaatacagtgtaatctgtgctatgatggcagaatgggcataaagaacacagaggaggaaaagataccccagcctggattcacagagaaggggggcttgagtgaagtcttgcagataaggagaatttggttaaatgaagaaagcagcgggccaagcacggtggctcacgcctgtattcccgcagtttggaaggccaaggcgggtggattgcctgaggtcaggagttcaagaccagcccggccaaaatagtgaaaccccgtctctactaaaaatacacacacacacacacacacaaaaattagctgggcatggtggcgggtacctgtaatcccagctacttgagaggctgagacaggagaatcacttgaacccaggatgcggaggttgcagtgagctgacgccactgcactccagcccaggcaacaagagcaaaactccatctggaaaaaaaaaaaaaagaaaagaaaagaaagcagaaaagagtattctaggccgggaacagtggctcatgtctgtaatcccagcactttaggaggtcaagatgggcagatcacttgaggccaggagttcgagaccagcctggccaacatggtgaaaccccatctccaataaaaatacaaaaattagctgggtgtggtggcatatgcccataaccccagttactcaggaggctgaggcacaagaattgcttgaacccgggaggcagaggttgcagtgagc

(The sequence listing continues in the following parts.)

The invention claimed is:

1. A method of identifying a human subject as having an increased risk of developing colorectal cancer, the method comprising detecting the presence of an allele corresponding to position 331 of SEQ ID NO:1084 from a sample obtained from the subject wherein presence of an A allele at position 331 of SEQ ID NO:1084 and/or a T allele at the corresponding position in the complementary strand of SEQ ID NO:1084 indicates that the subject has an increased risk of developing colorectal cancer.

2. The method of claim 1, wherein the sample is blood or saliva.

3. A method for identifying for a human subject as having an increased risk of developing colorectal cancer, said method comprising the steps of:
   (a) providing a sample containing genetic material from the subject;
   (b) amplifying the genetic material in the presence of a pair of primers wherein a first of the primers comprises at least 10 consecutive nucleotides of SEQ ID NO: 1084 or the complement of SEQ ID NO:1084 each located upstream of the base located at position 331 of each of said sequences and a second primer comprising at least 10 consecutive nucleotides selected from within the same sequence and located downstream of the base located at position 331 of each of said sequences; and
   (c) determining the identity of the base in the genetic material that corresponds to position 331, wherein the presence of an A allele corresponding to position 331 of SEQ ID NO:1084 and/or a T allele at the corresponding position in the complementary strand of SEQ ID NO:1084 indicates the subject has an increased risk of developing colorectal cancer.

4. The method of claim 1, wherein detecting the presence of the allele having an A corresponding to position 331 of SEQ ID NO:1084 and/or a T allele at the corresponding position in the complementary strand of SEQ ID NO:1084 is conducted with a kit comprising a probe that hybridizes to the allele.

5. The method of claim 3, wherein the sample is blood or saliva.

* * * * *